United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 23

SEQ ID NO: 33 - DNA, 4550419 bp, Flavonifractor plautii (residues 3,033,615-4,550,419 of 4,550,419)
  misc_feature (4542384)..(4542385): ">" designating noncontiguous sequence of whole genome
gcgtgaagcccggcggggatgggtgcacagaggttcttcacattttcttccatggattggccccccttctgtttggtaacgcaagtatatcgatcccggcggtaaatagccatcaccaacagcaacaaagattttgccggaaagcaagcataagcaacaatgtcagcccccctccgccgcccgggcgatgcccgccatgatatactccacgcatggcactgggacactattacccaaggccttgtaccgggcggagtccgaggcgccgggcatgtctgtccacccatccgggaacccctgaagccgctcacactccagtggagtgagacgccggatcaggaaaaccgccagtgtatcacggcttggctggcagatcagatcggtggcatccttcccctgacgggcactctgggtggaggcggtatcgccctctctgaatttgtccacccgctggcggcgaaaaatggcgtgccggtccgcactggtcagggtataggccacatcattttggatgccaatgccgttgccgccattgcggggctgccggtcaatggcattgccgcagatacacatagtcggctccggctggagggccagaggcaggttgttgcctccggtaccagccctggcggatagtgtgtgcacgatcggatgcggcccagtgtaccggctgtcaatgccgtggttctcaaaaaccaggggctgatgcccgtgctgttgtgcccgcagggttccggtcttatcttcagtgcagtccatgacgctgccgccctggtcgttgaggcagagcacggagggcatgcggttgccgctctggccggccttcagggtgggcgccgcacgctccgagtatccaatactgcccgcgctggcccccgccccggcggaaaacccggctgtaatatcccgggtatccgccaggccgcactcatcccaggcggccagccccgcctgcaccaggagggccgcatggagctggggcgggagaggcttgccccgctccttcgccctgcgcagaatgcccaggcaggctctcctggtcaaatagtattttcggggcggattgtcctgcaaaatcagcgacaaggaacaccctgcgtctccgctggggggtgccgggccagtattgagcgtcgaagaccttccacgccagggagaatgcagctcccactcgtaatttcccagcaggttgccagccccaggggtgaggtcgagtgaaaggtatggaattgcctgcaattccggcgatctgttccaggacgaaccggaagtcctcccctttagggaagccgctgctgaacacgccggggacattctcccagcagaaccatctggggcgaacagacttgcctgtccgccctcgtcgtatatccgcatcccgcatctcctttgtcacccggatctgctccaggaacagcccggaccgtgcgccggccagtccggcgcgggtacaggatgccacggataagtcctgacagggtgagccgccgcagataatgtccaccggcgccagcttcgccccgtccagcctgatgatatcccccatatggagcgtctccgggaaatgatgtttcgtgacttgaatggggaaggactcaatctcgctggcccacagtggggtgatcccctgccgtatggcggccagcggaaagccgccgatgccgtcaaacaagcttccgagggtaagggtcattttaccgcctggacaatggtgcgggtggtattgacggcagcctgggcggtgtagacggcgctcatgatattggctctggtggtggtgtccaggccgaaggccccggcgatgcggggcacctctccggcggccagcatgaggccaaggcccaggagggctttgtcgctgaacaccatgagccccgccaccaggatggtggcctggaggaaggcggtgaggcacaggccgatgacctgcttgcaccactgggtgaagccgtctgtgtagcctcgggggatggaaaacatatatagcgaacccacggcaatctggatgagcaggatgccgccccgtttcaagtttgagaagaacaccttgatcaccgcataagccatgaggatcatggcaaagaggagcatgatggggttagtgcccaggccccatttggcctgggccgcgatgtccatcaggccggcgccctccagatctgtgaggatttcattgcccaactccccgatgctctttcccgcccctgtgatttccatggcgaaggtaccctggagggagacggagagggcgtacagccggacgggtacggtagtgaacaggctgacagcgaagaagcctttgagtgcgttgagggcaggctgctggagattgccccggccagatgcgtactcaatgccgcactcaaaggcagacaccaccacgctgacggcaaagagggcccagcccagttgggagaagaagcgcaccactgaccgcacccaggagaggtcaaacagctccacccccatgttccccatctgggcgaagaaggcgcccaggaagcccaccatctggctgtaaaaccagtccaggatggactccatcaccgggttggccacaaagtcccaaataaacactcgccttcaccgcctcagatgcccacgatattccagatgtaattgggggccagcagcacgaagatcaggcagacgaacaggatggccgcccccgtccactcaaactggccgtgcttgcggtagtcgaagaagcacagtgccaccttgacaaagaatgcaatccccagcaccatggtgagggcggggaacaccacggtgttgaccacggtcttgatctggccggcggcatccgtccaggtctgctccacggcgtccgccacgttgccggcggaggaggcgaaggctgggactacgcacagggcggccaccaccagggccaggagcaggattctgatgctcttttttctcaaagtcactttcgtagcacctccatgaaattgaagggccgcccgggttgggcggccctcctgaagatgggttgctggaatcaatagccggtgcggggcaggggctccgagggcttgtagaccttggtcacccaccgggaggtggccataatccactggccgttgtacacgccgcccacgtccgcctggttgacgaattggctgccaccggtaagccaggcgtagacggtggcatagacctggggtgcctccacctgccggaagttggcgggcaccacgccgaaggacatcataaattcggtgacgtactcgttggaggccaggcacagggcggccttggaggcgtccagtacatagttctgctgggtgctcaggttgtccgccaaggtgcgccaagtgccgccactcaggttggtcttgtagaccaccttataattgcccggcacgttgtaggtgccagtgacaatcttgtccagccgcaccgcctggccgggcagggtatccctccagaaaaatgaggtaaggctggtggtggagttgttgccgatgccgctgaaatcgtagcggatctgttggccgggcataacctccacatagccggtcttttggatgcttacattggtgtagaggctcttgttggtcatagccaccttgacaatctggccggcaaactcgatctccacctcgatgggggtcttgtccaggccgtaaaagtctgcggccttggactccacgattttgtagcggcccagtgggagaggccgggaggatgcaacgccgttcttgtccgtctcaaccgtatcgactaagttgccggtccgggcgttgtagatctcaaactctgtgccggggatgggggtgccggcgggccagccgttgacactgttgtagtccgcggaggtctttgttatctggatctgtccagtgatgggggtgttctcccactccacctcggtggtctccccagactccacatagacggtctttttctccgtgtcaggaacatagccctcattctctaactctctgagataataccgcccggcctccagaccctcgatcagtacatacccctcgttattcgaagtgtactggccaacgggggtgttggtgctatcatagaggataaacggcaccccatagatgccctcgccggtggtgctgtccgttttgtggatcaggatggcgctcaccggcgtgttctccacctgtaggactgtggtttctccgtttttgacctcaaaataatggggagtgtcgtccaacttgaagccctccgcgctctcggtttccacggcatagtacgatccattctccagggccaggaacacccggccatttttgtcggtggtcacggtatccaccagggcgtcgtccatacggcggatttcaaatgtagtgttgggaatccgctccctggtgtcatccgcgttgaccttgatgatttccacgccgccgatggggtcgttatacaccgtgatggtctgggtgtcgttagggttgatgaccaccgtttgggtacgggtttcctcatggatggtgtagccctcgatggtcttggtctctgtgacgaggaatgtccccaccaaaccgtcaatcatgatctggccgttttcgtcagtgcggtagaggcccatgctggaggtcatgccgccgttgtcgtccaccaccgtgccgtccgcctcggtgatggtaaattccaccccctccaggggctcatgggtgacggaatccagcttgttgatgacaaggccgcccttgggggtgttggtgatgaccaccgtttgggtatctccaccctccccgatgactacattggtggagggggcgtccatgacgtacccatggggcgccttgatctccgtgagcacgtatgcgccgggggccaggttggtgatgcggatctcaccgctgctgtcggtggtgaaaataccgttctgggtgagggtggaatcgccaattaccccgtccagtcccacctcgcagccggcggccgtcgtcactcggaactgggccccggcgagaggctggcccgtggcgctgtcccgtttctggatgatcagctcacccttcggctgattcttaaaattgaggctgaccgtccggccctctttgatctgcacggtctgggcctgggtatcgatgaggtagcccggaggggcctgggtttccgtcaccaccacgctctttccgggctggaggccggagatcaggatctcaccattttcgtccgtccggtagatgccgttggagtccccaatgagggtgccgtccgcataggtgattttgaactccgcgtcgggcagggtctcgctgggattggtagcgcagaccttgcggatcaggaggttcccgtccggcatgttttcaaagcggacagtgatgacgctctgctccccgttgtctgccaggtagacggtctcggaggactggatgatgctgtacccgtccgccggatccacctcctccacgatgtacgatcctggcttcaggcccgtccagatggccatgccgttggagccggtcaccttctgtccgatcatggtgccgccggtaccggaggtgcctcccaggtagcggagctggaaggtggccccgcccagggcctcgccagtgacgctgtccgtcttgtgtaccacgatggcgttgagggggacgttctcaaatgtcagagacttgtttccgccgccctcaatatagacctcctgggtggcaggctccttgatggtgaagccgggggcgggttccagctccgtcacccggtaccagccgtcccgcaggccctccaacacgatctggccgctggcgtcggtgaagtaggtccccaggtcgttgagctcgccggtgtcggtggagttagaagcataccagatttgaaactttgcccctttgatgggatttccggtgatgctgtctaccttctggatggtaaggatgggctttttgtggttctcgaagtagacagtgtggttccggttgggatagagggtgaccagctggctgggggcatccagcagatagggggcaggtacggatttctccgtgacctcataaactccgggcagcaaattttccagggtggccgtgccgtctgccccggtcttgatttcatccacgctgtggccgtccgccgccttgacggtgaacacggcccccgccacgggtgcgccggtgtcggcatcccgcttcaccaccgtcaggttggggcggatgtcgttctctaggatgatcgtggaggtcttgccggggaagagctccacatggcgctctaccgggtctatgatgtggtctgaggtggtgtccagctccttgaccgaatacacccccggctccaggccggagatcaggatctctccattttcatcagtggtacggtccagataccggctgccgtcctcgattttggcgatgcggaaggtgaccccggccagccgggaaccgtccgcactcagcttgatgaggtgcagggagggtttcacagagttggtgaacacgaaccgggccgtctggttggcctccatctggatgatccgctgggcctcgtcgatgatgtagccggggcactccagctcggtgaccacataagccccggtgggcagctcagacaggtcgatttcgccgttctggtcggtggtgaactccgccgggccaaagttgccgtccacggcctcgatgcggaacctggcgttggggatcaccttggacgggtcggcgctgtccaccttgaccagccagatcccgggcttctggtcgttaaaaaagtagagctccttaatactgtctccggccttcagttcaatttcctgcggggtggaatccaccagatgtccactgtccccagtgtccacctcctggacgcggtaggtgcccggccggcagtccgtgagcagaatttctcccaaagcgtctgtctcatagtcccccagcagctccccatcccgccagatgcggaaggtgacgccgggcatagtctcatggctcaggcggtcgtacttgatgatcttcaggccgggcagggcctcgttcttcagggtataggtgacgcagtcccctgccaccacagtggtggtataggtctggggatcccgctgccaaccctctggggcggacagttcccggatttcgtatgcccccggcttcagcttcgtgaaggtataggaacctccggtgccggtgatgccggtataggtggcgccgctctcaatgtgcttgatctgtaccttggccccggccaggctggccccggtggccccgtcgatcttctcgatacgcaggtcgccgtagggttcattttcaaagtccacctcggcggtctctccgtacttcacagtgacctgcttgaccggctcctcgtccagcaggtgatactccgggggtacccgctcatagatggtgtaattgcccacctcggtgagagggatggcgatggaaccggattccggcgtggtgtagatgccgatggtgtctccgtccgggcccaccacctcgaaggtggcgccggagagggtgacagtggtgcccgcctcatacttggtgatcttgagggcggtctcgctgggagggggcgtaggctcgtctggggcatccggctcgtcggtatccgaatagttagagatggcgtttcgcagcaggctgaccttgggatccgtgtcgcagaggtagctctggaggttgccgtactggtcaacctcctggcaaagcgcgtaaaatacgacatactggtacacatcggctgagagggagagctggacgctgccactctggcccgctacgctgtcctctgggtagagcaccttgaaggtccccttgtagccgtctccggtattggagaccttgacctgggtaatatcctggttgttctcatccgcaatacgggcgccctccggtacgtccgtcccatcctggaacgatacattaacagcctgtccgtccacccaggtaggggaggtgacggtaaacacctgctggcggtaggcggccccgtcaatggtgacggggtaggccgtctcctggtccggggaggtggtgagctggggctccgccacgctggtccaccgggtgccctccgtgtagatctggacggcggcgttgaggatattttccccaatctcccgctccgtgccagtaaggccgggggccacggtgacggcgctgatgtcccactcggggatcaggtagcaccacagggcaatcttgccggcgtaaaaggcctgatatttgttatccagccccagttcctccaaggagcggtgggggtacatattggcaatcagccccactaccttgggatcgctggccttctcctcagccagataacggatgctctccccctctggaactgtttggggcacgccgtactggttggggttgacacagtacgctgggatctcctgggtctccccggcggcgttttcgtaaaggaagtaagtatacgactgggtctgcaccctgccgttgacggccagataattcatggagtagccgccgctgtaaatgttgacctcacccagggcctcctccggggtggaggcggcacccgtcggcaggatcagcagggacagggccaccgccagggtgagcatcaggctgatgattcgtttcatttgcaaacttccctcctaagcaaaaagcgggaggcttgccgcctcccgccggtttgtctgggacgctgttaggtcacatccctctgatattatattcggtatagagatatttcccgtcgtggtacacatcccaggcttccacctcgaaccgggcccccggcgcggagcagaatacttgggtaagctggtcttcctgccagggccagaacatctgcaccgcgttctgtgcagagatgcccaggtgcaggttgagagcgggggcaccatccgcccacagctctggacagttcactgcggcgttgtagatggtgtactccatccgccgggtctcatagaggtttcgaatgtgcaggttgtccccatattcactttgaaaccgacgcacctccgccttcggcaactccagctccgggaagcgcgtctggtcataggcgggcaggggttccggctcctcccacagacgcagatccgtgatctcataggtggtgccgtcatcgcagagcaccttgtccccctccttcagccggaggggctcgtccgactgggggacggtgaccaccccggagggggcggacaccgcactttcctctgtgtaaggggagctggtgtctaccaggacacggttggcgccctggtcatacgccacgccgaagtctaccgcccggccgacgtcccggagctgcacatagttgtggccatggatgacatacgcttccagatccacctgcttgccgtctatatagaaggtctgggtgcttggggctgcagtgagggcaaccacccccgccgacgcgggccccaccagtgctgcgcctatcaaggtacctgccaataccgccggaataagctgtttccttttcatacggttgacctccttctttcctctgctgtccttgtgttccttacagcaacaacataccggaaatatggggaaaagtctatagcaaagggggggcccggtggagaaaatgagcccgcaaaacaaagcaggttacacaacctccgccgcctgcacctgccagcggtaggtcctctggttacgcacgcaggtgtagagagtgagcttgttctcgttggaaggggcggtgccgctggtatccgtctccttgaccttctgcacactggtgacctcataggtgcggacacccagcttggtggtccaggtgatggtatctccccgctccagggtgtggagatctccaaagtcgtcccgcaccccctggttgtgtccggcgatggcgcagtttccatcccagatgctggtgcctttgaaatgtcccgcgcccttcatgagcgtggagctgtctgtatcctcatagacccgcacactcaggccgatggcggggatttttaaggtacccaggtatccgccggagtagtagaggtccgaggccaccggggtatagcccaaggtgccgccagattccgtctcctgctccggttccgcggggacggcggtgaaggtgtccacagaaggcgggaacacaacgggcatcccgctgccgttgacggcgcccactgccataccctccggggccagattgggggtaagccaggttccggtgttcagagtatccgcactggcgcttccgaagcccggcgggatgagggcggcatttttgctgatgtcctcatttttcagggccccaccatctgccgtatgtaccacctccaccgaggtgaacttgccgaagtccggcccctccggcgcatcaatggcgtaatctaaagcacccgccggggtggccatagctgccgccaggcaggcggccaggcaaagggtggtcagcttcttcattccgtatcctcctctttgaattcccggcgccgtttgacgaacaggcaggcgccgatcacgccgcccacagcaaagaccacgcccagcgggagcaggatggccacccagttgaactgggccaggccgtccccaggctcctccatgggtacggtgggttccaggggttccccctcaaagatggccacgtagcgcacccggttcagggcgatgcggctgacggtaccggtgtagtctgccgtgacggtatagccggtgacataactgctggtggcggtgccggtataggtggccacggcggtgtagcggtctccaatggcgtagccggacatgccggtggtgttgtccgtccgccagtcaatgttctggagggtgaggatacgcccgtcctcctcgatgctcttggggatgctggcggtatcctggctggctaggttggggtaggagcggatggcggacacctcccgggtggagctgccgtagcccgccgcctccagctggacagtgtccagctggagggacagggtgccggacagtccgtcctctgtgacgaactccttctcctggggcagaagggtcaggatggactccatatccttgcttttactctccaacgataccgtttccgtgtgcgggcggctctcatgctccggcagctcctgctgaagcagatccgtcagggtgtagtggaagccgtcctgctcgaagtccgaccgggggataccggcagggtcctgctccggggaaaggtcatagaccttgcggatctccgccccgtcctcactgcgtgtgacagaggttggatagcagacctgcacctcggtgaccgcggggaatggctccgccgccagggcggttgggagcagcgccgcggctatcaacaggccggcggcgcatctcagaatggtgcgtttcacgatggggttcctccttcacattttgtcatattttgctccagccgctccagagtgcgccgggccaggaggcggaactcccagggctccagctccagggggcggtagtcgcctttgtccgtgatgccgtccgcccgcaccttgagcaccaggggcagcacggcagggtgctcctcgagcaccgtgggggccagccagcccttcccggccagatacacccaccggagggcggaggcaggattaccagggacgtcgggccagaggtatttccccgccagcttcttgcggcgctgcttcttgttgacggggatgggggccaggatcttgccctcaatttggtagcgaaggccaagatcctctacacaggcgcggaatgcctggcaggcctctggagtgtccgcccattgaggcagcggctcccccaactctgaggccagcacatcttccccctctggatcatctgggaagaggggcacgttcttcaccagctccagcacatggaagccgtccgtcaggcccagcaccttccgcttggtgatgggcatgccccggtagtgcgccagggcctcccccagctccgggcgctgccggatcgtccagcctttctgtaggaagccgccccggcccagccgcagatcatccatggtgtaataggccaagctcattcggcatcctcctcccgggtcagcagggcgcccaacccgaacaaatccacgccgcaatgctccagcatatccaggaactccgcgtcataggttcggaatacctcggacgctcttttgcacggcataccgctggctgaccggctgtccagagccaagcggacaaccatgccgacgttcagatcgtggagcagccggatggcctctaactgctcccttgcagtgggctcctgccgggtaagcacgatgcagccgtgctctgtatgcagggccagccgctccgcgtcctccagtccggagagctggagggcggcccgggggatggccagggtcttcttgcttgtgtcatggcagatggtaaatttcatcttctgttttcacctcgtattcttagtcctgcggccagtcccacacccgaggcagccgcccggtaggggcggacaggatccgcagctccggccggtcgctggacaccagtccggggttatccagcagggagagctggcggttgagcatggggcttgggtcaaagttggtcatgagcagctcgtggtacctggagtcctcctgccgggccatggggttggggcggtcaaagcccacaatataaaagtccggggcgaagaggtccagaatgtccggatggctgttataggacaggacgatgtggctgtcccgcgccgccggggcgcacaggcagtcgtggagccggacgtggtcccggaggtcgaaggagggggcgtacatcctctccgcctccagatagggcgggtccgcatagatcaccgcacccggccgggcgtactgtcggactacgtcgcagcagtccttgttctccaccaccacgccctggagtgtgtccgaggcgcgtcggagcagtccgaggaagcggcgcagctccacgctgcgcccgccgaagctgtttccggtggcactgtagctgtaccggatgctcagataataggccgcagcccgctgtacgtccggcaggttggcccggcccaccaggagcttcttcacctcctgcctgtccatgggcgggaagtagtcctctgcgatttggagctcctcctccaggtagtccatggggtcatactcgtggttgaggaagcggaacaccacctcgaagtccgccctggcgtggaggggcaggaagtccagctccctgagcagcgccaggggccggtcccgggcacagcggaacaggttggccagatccgtgtcgatatcgttgtacacccgcaggggggcgtacccggcgcccaggcccagggtcaccgcgccgctgccgccgcagacctccagcaggcggggcgccctcctggggagcagctggaagatgtaggggagcaggaacagcttcccgcctacccagggaaagaagggcttagcgatccgcctcacctcccccaggcaggcggaagtcccccgtggacctctccaagctgcggatggccttctccacgccgtcccgcattcgccggagatgcccgattgtggcaatcacctcccaggcgttggcggggtagaagtagccggtgcggtcgctgcagataggcgccccgtccacccgcaggttatggaccagcttccgcagctctgcctcatggatgcggaacctctttttcatctgtttgccactgatggcgttttcccggccggggcagtgcttcttcaggtactccagcagttgcttctctttggctttcatgacgtcctccttttccgggccgtcctcccgaaaaagggcacaaaaaacaggggccgctgtccccttcgggaaaacggcccctgtttcgttttgatatagatttgatctggggttacatctgctgcatctgttggggcgcctgggattgcgtctgctgcctagcaatgtatgcacatccgtcctctgtcaaggtatagcccttcttccgcagcaaatccagtccgtaccgttccagatcaatgcagcctgacagggcccgatccacacatcccaaccgcacgcgcagatccatccacgccatgtcttggagctgatccgcccgcaccacctggtagcggttcaggttctgcgccaaatccagggcagcgggcagggtggcgcagtgctcatactccagtatccagagataggcctggaggaaccccttctgcccctggttctgttcctggaggataaatcccaggttctgaccgtcatagatgagatcctccagccgtcccctatatgcatcctccaggccggtgatccccggcaggctgcaccgggcctccagcagggtgcactcccggatggtctgcacacccagagcgtccagggccagccggatctcccccggcctcacgtccatgatgtcgttgtagtccggcagcgccagccacaccccctccggcaccgcggaggaggccagcttcagccgcaggctccagctgtagtccggcccaggcaggttgaccccgtcgtagaagcccgtcaccccctttcgcggatataccacatagcagccccctgcgaaccggccggggtgctgtgcctcatactgcctgcccagcttgtccaggtcgatgtagtcccgcagcgccaggagcctggcgttggtctcctccaggtaatacaggcccagatcctcataactctggatgccgcccaacacctcatactcgtccaggctggccagcaggctgaccacctctgtactgtcctgggcgggatggcgctggatggccgcgtccaaggcgatcccctcccgcgcggtcaacacctccagccgctcccgcagccagtcctgctcctccggcctgccggggagctgtaaaagtcctgctttatccatgggcgtttcacctcatttccatctgtacgccgccccgggtgggctggggcggcagcggtttctgcaccggctggccatccgcccgggtcagcagaccgtagtctgtcagctcgcccccgtactgctggatcagcgcctcgccgtagccgtagaggttcaggtaccagcacagcaggtcggcattctcctcccccatggagcggcgcagctccccgcgggccacgtcctctggagaggcggctgcccaattcagattgtaggcgtccagccgttccgtcaacgccatggcatcctccaggctcgaaatggacgacacctccagcaccgccttgtacttgatcagggccagagagtcccgctccgccagcaccatcagccggatggccaggcagttcagggtatccagccgctccggcgtggcccacgctgccggaagctggggcacccggctgtggaaggcggtgacggcgcagttggggaggcccacggcctccatccgctcccgcacctccaccagctcctgtccggcggggagggtgagctccgcccgttcctccccgagctggagctccagccgaaagaagccagttggggcctccggcgcgatgcggggttcctggccctctgtgggcttccagttcccatccggtaccacatacccctgcctggtaaagaccccgcccgccgactgacggatccggcggcccaggagctggaagtccaacagttcaaataccttgtccggcacatccttcacctcggggatggaaccgtttgccgcgtaaacccggcccaacgaggcgtcgtccgtggcctcgggcaccacgtggcagtgctctgcctgttccgacaatgcggtaaacgtgcgcagagggatgacaccgctccgactgctttccagcctgaccagcccctcgaaggcagtgcgctgtcggctgtccaggctggccagccgctccgccagggcattgagcgcggggaaaccctcgccagattgcaggctagggaacaggatggggaattccccatagtcctccatctcccattccactctggtgtccggcgcgggccgcagccgttcccaggcatccaggacagcatacgggtctgctggaagctccagtgtcacataagtatccttgtccggattgcacagggatactgtaaaggccttatccacggctcataccccccatcgtcatgccctgggcctgcgtcagcccgaactgctcagcctccgtctggatgctccagccctccggctgccacatgtggacgtaaagctccccgccgtccacacggattgcctgctgctccaggccctcgccaacgccgtccgcggcctggccggtgagatagtccttcagcccggtcagctcctccggagagagctggccgacgacctggcactccgccacgccccacagcctgccgtctctggcctctgccgtaaacacggcggagcgcaccttgacgtccaggaactccttgtcgcaccagagcatgaggccccgctccgcctcctccggcacccggttccgtaccatgaagcccaggatcctgtcctcatagtccagaagcgttctgccgtcccattcttcacccgtctcatcccaatctccccactcattccgggcatagaagctggcggtgaggggcatgtacagcttgagctgggtggactcaggcgggtggacggagaacatctcctccccaagggtcaggacgcactcacctccgtcgctctgccggacgtggaaccggcccgagtcatcgatgtgctccagagtaccagcctcctccagcgtgtttctgggatcatccagctcccatgtttggatccggctgcccgcggggaactgattccgcaggaaatccagccactccttcgatacaccctgcatgatgatctgtctcccttcattttgcctcaagtgtcattcggatagaaaaggccggcttccaaagcggaagccggccttcaacggagtccctgtgcatgctctgtttcctctgatggttcatagttctttcccgtcctttcttctggtaagcacacaacataccacagtgtgcccgtaatatccagcattttttacatctgcggctgcatgggcgcctgactctgactccgctccagccacagcggataataggccacctctgtgatacccagatccgcattacaggtgatatgggcggccacggcggggcaggctgacgagatctggaacaacgcctcggtgagctctgagcccaggccgtccaggatacagcggggcccgccgggcttttcggcaaactccggttgatccatggtgaggcgggccatggcctgggtggcggatatgcctgtttcccggccgtatgtgatggcccgcttcaaggcatgctgcggattgaagcgcccaaagtccatggtgtaaaaccgctgttcctgcccggactccacaatggtgcaggtcgcaatccggctgggctcctccggccgctccgggccaaagaagcccataagccggccctccttggccaggccggacacctctgccggtgtgcgcccggcctgaaagtagacggcagcggcgaacagctcgctgggcagagcggcgttttggtgctggatgacctcataggcgccctggagggtttcctcaccgaaattccgcgccaccactcgcagggcggtgagcatatcgatgtactccgtctccgcacactcccggtcaaagcggtacagcgcctcggtggtgacggggtccggcctgggaaccagttcattgatctgccggataaactcttttttctgtatattctctccccctcggttcacatggatagcccgcccagggatggcccctggctggggtgatccttgtcggccagcagttgtaccagagttttcaaatcctccggtgcaatccgctcaaccgcctggcacagccggttgaggccattgatggacaggcgttccgccggaatgctgctgatgacctcgccgggcagggtgctgtctactatccaaaagtgggggctgtcccggatgccggtgcggcacaggagacgttccagcctttccgggctgtccggcagaaccagcagtgtgctctgcccctcgccgtaggatgcctccaggagtatgacgaactcccggtcaagatagtccggaaaggggccgccctccttgtagaacttctccagctccataccgttatcataaaccacgccatagggtgtgatagtgccatgcttgttgaggatcaacttcaaggccgctgctctgccatccacctgttccagctcctcctcactggcacagccgccctccagcgtcatgtaatgctggcggcctacagcgtccaaatccgaaaagtccgtgatcaccgtggcctgctggcagcagaaggtaagattgatgaagtccgtcatatcaaacgtacccagcctgaccgccatagcctggaactgggcggcctcatagtcgtcaaagctgtccagccgccgggccaggtagtccagctcgtccagattggcgcccaccttctccaggcgtttgaggatggggaagccgctctccagctcgtccacccggcagtcccgtttcaggggggctcccagctccatagcggccaggcattccagggtgcgctcatattccatgccggggatggggaaggggatggtcacctggccatactccgggtgcgccgcgttgctcaggacacagcgcagcaccggctgtctgttctgtgtggtcacatctgctgccctcctatctccggcccctggcggggcacgtaatcctccagcggcctggggttctcctccccatacaggtcataggtcatatcgtccgccgccttgcgcaccgccgggtcatccgtcagggtctcgaagcggaagccggtcacatcccttgtgggcagctcctcccggatggtccggaggtaatcctgtggggctgtgaactccatgcgctcgccattggcaaaggaaacccggcccaccggcctgtccagtcccagtgttctgtccgcctggtcatctgagtagaacaggccggcctcctcacgggcggccggccgcaggggaaagcgattgttacatggattcatctgtgtgaatctcctccttagtttcttgctctgcccacctgtccgtggcattgagccgccgcatctccgagcgcaggcacttcccatccttcccccagcagaggaagccgttggcagggtaggggcagcccacacagaggggggagcgggtgcatactggcctgggcggcggttccgccgggtgctccggggcataaatcttacgggcactgaaatggaataaaatctgggcatagaaaaaggcggcgcctgatttggcgccgccctcacatggacggttcaagatttactccctctttctatatcagatgttgcgctaccgctggcggttagcctcgccctgggacagggcggcctttccactccagtggaagtaaacgatccttctttggcgcaaaggtgaggggggctgtccaaggacagcccccctcctgtatgcttccgtctcagattttagatggcccgcactccgcgatccaactgtccaggttcaggctttccgccatgagaagggccagcttgtgcatcgccgcccggtcttgggcatcctccagcctggccgtcgtctcaaacaggccccagagcagttcggcaatcatcttgccgtcgtaaggcttcagcagttcgctgttgggcagagcgtcctcgctgctcccgctgcgcagaagctgccgttctctttcaatcagctccaggctggcctgcaggctctcccggggcacttcccaggctttggcaatcagcttcacgcctgcctccatgggagcctcatccccgatcttgtccggcccgcccagcgccagggcattgattgcctcctcagttatctgctgaagcagcttctccggcgcgggatgcttctcaatctgtttcatacgtgtgtcctcctcgttattttttggtgggcttctgaccacaacaatacccgcttttgcgggataaagctatcaccatacgtaacgaaaaaaatgccgcaaaccaagcgataccaacaatttctgtatagaaaaagcggcgcctgatttggcaccgccctcatatggactgtccaagcttctgactttcgctctgcatctgatcctgggttctttccggcagctgggctgtgatctgatccaggaggcgccggcattggaactcctgctggtaggaggcgggccctctccatagaggaagccctgcaccgcctggcgcagcccctccagctgctcccggtcaaagacccgttccctggccaccagcccggagcggagggcgaagtcctccctggcgccctgatagtcctccatgtagtagtggccgttgttgaccccgctccggtcatagtcccgggcccaggtgacgaactgggcccccagcagcgtctctgtcccggccagcactgtgccgttgaactctgccagcacccggtaaccgtccgccaggccatccgccttcagaggtggggcattctccagaagcgtcatgtactccatcaccgtccccgccgcctccgtgacctgggccagggcggcctttgccctgctggtgtccacccaggtggggtcataccggacgacgccgctctccgtgacccgacacaggatgcggccgttccactccaccgggagcaggccgtcctcctccagcgaccggggcagcagctcccgccgtcgcagggcgtaggacagctcttcgaaataggttttggcggtcatattcatattcctcctttggactcagcgccctttttcgattatcgttctgtacccctgcccaggaatttcaccataccatcatctctataaaaatctattcagcaaagcggacacaaaagtgtgcgccctttttgaacttcctgggcaacaaaaaagcgccggtctgatggttgcgaaaccaacaaaccgacgcgctactttttgtatatattttttcctccatttggtggccttggagcctgaaaaagggcgcaggggagggttaaccggtattttatggagcaatccggggggcaatgtccttctgtggctccataaacctcgaaaatatcttttttccagaacgcaaatttcaggaaaataaaaaagccacaccctctgatactctaagcgttccgcttaaaatatccagattggtgtggctttatggtgccggtagtgggactcgaacccacacgatgttgccatcaacggattttgaatccgtcacgtctaccaattccatcataccggcaacgggactgcaaaatattatacacgacattgaagcggttggcaagtcttttcgatggaggaaaatcagaaaataatcggttaattaacataccatttccggtagagatgtgctatgataatcttgattttataacttatcccatggaggggttccgacgatgaaaaaatgcaggctgcttttggcggcggggctgctgatgtttctgaccggctgtttttcccagtcggtggaggaattctacgcgcctcccaaggcgcccgacgattatctgaagctggacaatgagatcaacaaggtgctcacgcaagggggcgagtacgccgcgcccctcagcggggagctgacccagaaggtgcagcttcaggatttggacggggatggcgtacaggaggctattgcctttttccgggtgagtgcggatgagcggccgctgaagatctacatctaccgccaagtgggggagaactacgaggtggcggccgtgattgagggctcaggaaatgcgattgactccatctactatgagaaccttgacgacagcccctccaaggagctcatcgtggactgggagacagcggggcagaggcactccctggcggcttactccatcgaccgttatgaggtgcttgagttgatgcgcaccgaccacgccggcttccagatttatgacgttgacggggatggacagaaggaaatcctcgtgctccagatggcggcaggggaagtgggccaggcagagagctttgtcaacagcgcgccgggcagccgagtggaggtctataacttccgggatggtatcctggagctggacgcctccgcaccactgtccaacggggtggagaagctggtcagcatgaagacgggctatctccagaacatggcgccggcgctgtttgtcacctccacctacgctgaaaacgggcagatcaccgacattttcgcctggaaaaacggggggctggagaatgtgaccctggagccggacaccggcgagagcgacagcaccatccggtggtccaccgaggtggagagcacgaaggtatcctataccgacatcaaccatgacggcatactggagctgccatccgcctatgcgctccccgatcccaacaatgtggggacggcccccaacttctgggccatccgctggtggcagtacgacatcaacggggtttctcatctggtatataccacctaccacaacagccgggacggctggtactttgttctgcccgaggcgtggtcggggaaggtgacgctctcccgcagcgacttggcgggcggcggcgagcgggccgtaatcttttcttactgggagggaagcgcggacacagcgccggtgccgttcctggtcatctacaagctgaccggcgacaaccgcgtaatgcgggccaacatggccgaccgctttctcctgcccaacaccggggaggagaaggagaccatttatgccgcgcgcctgatcgagagtggttgggactgcggcttggacgaggagggcgtaaaggccaatttcgccctgattaccagcgattagcgcccacggcggacgcctgtgtgcgaaaggaggaaacgggatgaaaaaggtactggtgctggaggatgaggcgaacatccgcagctttgtggtcattaaccttaagcgggccggctatgaggccatcgaggccgagaccggggaggaggcgctggcccagctcaagcgcaacccggacatcaaggtggcgctgctggacatcatgctgcccgacatggacggatttgaggtctgccgccgtatccgggcgggagacaacaacatcggcattatcatgctcaccgcccgcacgcaggagatggacaaggtgaccgggctgatgaccggggcggacgactatgtgaccaagcccttctctccggcggagctcaccgcccgcatcgacgccctctaccgccgtaccggcggaggggacccggtggataccggcgagatcagccagccgcctttcctgctgaacacccgcaaccgtaccctggagaaaaacggacagcgggtcaagcttacacaggtggagtactccatcataaagctgtttatggacaacccgggaaaagccctctcccgggaggaaattctcgactcggtgtggggacgggactacttcggcgagctgaagatcgtggacgtaaacatccgacgcctgcgcattaaaatcgaagacgaccccacaaatcctgcttatatcaccaccgtgtggggatacgggtataagtggggcttttagccagaggcggacggggcgtcttcgatgggccccgccctggggcgcggcggcgcggagcgccgtacaagcgtttttgccggaggcaaaagccttggcccggggcaattcacttgccccgggcagagggaaaagaggggtccccgcaaagctctgctttgcggggcatgacgatcccacaaatcctgcttatatcaccaccgtgtggggctatggatataagtggggcttttaatgccggccgggcggccgggacctagaaccaaacccaggtggtgacaacaagatccatgaagaaaatcacaggtatccgaaagcggtggatggtgaactccatcagtgtggtgctgtttatcgtgctgctggcggtggcggccttctccgccgcgatggggagctactactattccaccctgagtgagtctctcaagcagaaggcggaaaacgccatcagcagctttgactactaccgcacagaagccgagtattacgacaatgcccgggcggtggtggccggggaacccaacagcgacaagctggaggtagagtatctggatgccgacggccagattcgcttttccagctccgacctgacggcctttcgctcccccggaacgccggacattgccgaggccatcagcatgaagcgcactaaggtatggatcggcgccgaccccagcaccggcgagcacatcatggccgcctccagccccctgatgatcgacggggaggtggttggggtcatgcggtatgtcacctccctgaataaggtggacaagcagattatcatcatcgtggccatcgccttgggcatcggtctgggtatcctgggcatggtgtacttctccaacctctacttcatccgctccatcgtagacccggtggcgggcatcacggaaaccgccaagcgcatcgccgcgggctcctacggcgtacagattgagaaacgctatgacgacgaaatcggcgccctcaccgacaccatcaacgacatgtcgctgaagattaaccagagcgaaaagatgaaaaacgagtttatatcgtcagtgtcccatgaactgcgtactcccctgaccgcgatcaatggctgggcggaaaccatcatgaacggcgaggtgcgggacgcgggagatgtgaagaaggggatggggatcatcgtctccgaggcgcggcggctgaccaacatggtggaggagctgctggagttctcccgcatccaggacggccgcttcaccctgtcagtggagcccatggacatcaaggcggaactggaggatgcggtctacacctaccgggagttcttccggcgggagggcattgaactcaaccacttcgactgcgacgaggagtttccgcccatcgcgggggacccggagcggctgcggcaggtgttctgcaacctgttggacaacgccgccaagcacggcggctcgggcaagcgcattgataccgctatcgcccgggacgaggaccaggtggttatcaccatccgggactacggccccggtatcccggccgaggagctgccccacgtgaagtacaagttctataaggggtcctccaaggcgaggggttccggcattggactggcggtgtgcgacgagattattacccgccacgagggtaccctggatattgacaacgccgaggggggagggtgcattgtaaccatccatttgccaatccgagctcaggcggtaatcgaacaaaagttctaaaaatcaaacccgcgccccttgcaatcggggcgcgggtttggtacaatagacgaaacgattgaatccaattagttaaggagaacagtgtacgaatgccaaatgaaacaaagcaatcctgcgccacagcctacaagaccatgatcggcggacaggcactcattgagggaattatgatgctgggaccggagaagaaggccgttgtggtgcgcaagccggacggcgggttggaggagcaggtggaggagcgggtgctcatcaaggacaagcaccccgccctgggcctgccgctgctccggggtgtcttcaatttctgctcctccctggccaacggcgtcaaggcgttgatgtactcggcttcctttttcccggaggacgaggaggagccggaggagccctcccggttcgagctctggctggacagacacctgggcagcgagaaggccgcctccttttttatcaccgtggcggtggtgctgggcatcgttttctccgtggggctgttcatcctgctgcccaccgccctcaccggactggtgggcctggccgttcccctgcccatgtggctgcgcaacctgctggaaggcgtggtgcgtatcgtcatcttcatgggctatctgatgctctgttcccatatgaaggacatccgccgggtgttccagtaccacggcgcggagcacaagaccatcttctgctatgaacacggcctgcccctgacggtggagaacgtgcgtattcagccacgccaccacccccgctgcggaaccagcttcctctttgtggtgattgtggtgagtatcctgctgtccagcgtgctgttctcctttgtggaggtgacaaacacgtttgcgaggatggggctgcacctgctgctgttgccggtgattgtcagcctgacctatgagctgaaccgtgtggtggggcgctacgacaaccggctcacccggctggtgtccgctcccggcatgtggctccagaactggaccacctttgagccggacgactccatgatcgaggtgggcatccgggcatttacactggtgctgccggaggagaaggggaaggatcagtggtaaaggggaccggcgggatgaggcaccagcagaaataaaaccgctgtgccgcccagacggcagagcccacgtgaggcgatgcatagttgtcccatgaagaaaatggggggataaccgcctggtattcccctggagagaggaaattagagagagacagaggagtggtttctgtatggcggccacgtacaacaacctctacctggatgcccgcaagcggctgagagaggccggcgtggagggcgcccagctggaggcgcgggagctggtctgctgtgcggccggcaagagccgggagcagttttaccgggatatggccctttatgcctccgacccggtggaggagaagctggcggagctgctggagcggcggctggccggggagccggtggcctacctcatcggggagtgggagttctatggcctgggcctggatatcacccccgacgtgctgatcccccggatggacaccgaggtgctggccgagcgggccatcctgctggcccgggccgccggagagggggcgagggtgctggatttgtgcgccgggagcggctgcgtgggtctggcggtggccgccaacgtgccaggctgccgggtggtgctggccgatgtgagcgaggcggccctccggctgtgcaagcagaatgtccgccgcaacgagctcaacgcccgggtgacctgcgttcaggccgacgccctggagccgcccgacgcggccctgtgggatttcgacgtgatcgcctgcaacccgccctatatccccaccggggatatcgcggagctggacgtgagcgtgcgggactacgagccccgctccgccctggacggcggggccgacggactggacttttaccgggccatcgccgcccagtggggggccgccctgcggctgggcggagccctgctgtttgaggtgggcatcggccaagccggcgacgtgggggccattctggcccaaaatcagtttgagcagattcagaccttccaggacacccagggcatcggccgggtggtggagggcgttttgaattcataagggcgggcagcggcccgcccgccgtgagaggagaagtacacacatggcagacaagaagaaggccgcggtggaatccgccgcccccgccgccgataagaagaaggccctggagaccgccatggcccagatcgagaaggcctacggcaagggttccatcatgcgcctgggcgacaacgccgacatcgtggtggaggccatccccaccggctccctgtccctggatctggccctgggcatcggcggcgtcccccgggggcgcatcatcgaaatctacggccccgagtcctccggtaagaccaccctggccctccacatcgtggccgaggcccagaagcggggcggcgaggtggccttcatcgacgccgagcacgccctggatccctactatgcccgggccctgggggtggacattgactccatgctgatctcccagcccgacaccggcgagcagggcctggagatctgcgaggccctggtgcgctccggcgccatcgacgtggtggtggtggactccgtggccgccctcacaccccgggccgagatcgagggcgacatgggcgactcccacgtgggcctgctggcccgcctcatgagccaggccctgcgcaagctggccggctccatcgccaagaccaactgcgtggtcatctttatcaaccagctccgcgaaaaggtaggcgtgatgtacggcaacccggaggtcaccaccggcggccgggcgctgaagttctatgcctccgtccgcatcgacgtgcggcgtatcgagtcgctgaaaagcggctcggagatcattggcaaccgcacccgggccaaggtggtcaagaacaaggtctctcctcccttcaaggaggcggagttcgatatcatgtacggcgagggtatctctaggatcggcgagatcctggatctgggcgccaagctggatctggtgcagaaatccggctcctggttcgccatgggggagacccgcctgggccagggccgtgatgcggccaagcagtacctgaaggacaatccggaggtgtgcgacaagctggaggccgacatccgccgcaacgcctacaagcttatgagtagccaggcccgggccgcggccaaggccgcaggccgggcggtggacatctccgccgaggacttcgaggatgcggattcgtaagctggccccctccgtccgggtggggggccgctggctctgccacctggaggacggaaccatcctccgcctgggggagagcgaggtagtggccttcggcctgggcaccggcaaggagctggatgaggcggagctgtccgccttgaccgaggccgcccgcgccgcccaggtgcgggagaaggcggtggagctgctgtccgcccgccccctctcccggaaggagctggtggaaaagctcaccgcccgccctcggaaccgggaaaaggagcccctctgcggccgggaggccgccgaggcggcggccgactggctgaaggggctgggctatctggacgacgggcagtatgcccgcacggtggcggagcactgtgctgccaagggctacggtcccggccgcatccgggaggagctctaccgccggggggtgccgcgggactgctgggacggcgctctggaggggctgtccggcccggaggaggccatcgacgcctttttgcagaagaagctgcggggggcggagctctccgatcccaaggtgcgccggcgggcagccgacgctctggcccgccggggctaccgctgggaggacatcagtgccggcctgcgccgctatggtgcggagccggaggaatggtaggaagaacgcggcggaccgccgcatgtgagaaaggagcacagaccatggacacgatggaagccctgctgacccgccgcagcatccggaagtacaggccggagccggtctccatagaggatttgaaggagattctggccgccggggccaccgccccctccgccgtcaatatgcagcactggtattttgtggccgtacaggaccccgccgcgttggaggaggtcaaggccatcatgggcggcgtggtggagaaattccagcctgtgctggaggaacgcttttcccgccacccggagcagatcggcatcaccaaccgcttcctgtccaccctgggcggggcgccggtgtgcctgctggttttcatgctcaagccggactatcccgatcgggacggagccatgcagagcgtgtccgccgccatcgagaacgtgctgctggcggcctgggccaagggcatcggctcctgctggctgtccgcgccccagcgtatgggcttcggccctgcgttccagcgccgcttcgcccccgacaagggggagttcgtggcagcggtcaccctgggctaccccgaccagcagcccaaaatgccgccccggcgggacggccgctatctgatcgtataaggagaagttttcattgaaggttgcatttgtatccctgggctgcgccaagaatctggtgaacaccgagcagatgatggcactggtccgaagcgccgggcatgagatcaccgcccagcccgagggggcggacgcggcggtgctcaacacctgcggctttatcgactccgccaagagcgaggccattcagaatatcctggagctggccgagctgaaaaaggaggggaagctgggcaagctgctggtcaccggctgcctgtcccagcgctatcaggacgagctgatggaggagctgcccgaggtggacggcgtcatgggcaccggcagctacaccgagatcgtccccgccctggaggagctgatggccgggggcacgccccaccgcttcggggatatcgaccacacggaggaggacggggcgcgcatcccctccaccccctcctacaccgcctacctgaagatcgccgagggctgcgaccaccggtgcgccttctgtatcattcccaagctgcggggccgctaccgcagccgtaccatggagtccctgctggcggaggccaaggccctggccgatgccggggtgaaggagctcatcgtcattgcccaggacatcacccgctacggcatcgacctctaccacaagcggatgctgggggagctgctcaccgagctgtgcaagctgccctttcactggattcgcctgcactacctgtaccccgacgatctggacgacgccctcatcgacgtcatcgcccgtgaacctaaggtgctcaactacatcgacatccccctccagcacatcaacgacggcattctgaagcgcatgtgccgccgctccaccaaggcggagatcctcgccctgctggccaagctgcgggaccgcctgcctggtctggtgctgcgcacctccctgatctgcggcctgcccggcgaggggaaggcggagtttgaggagctgtgcgagtttctgcgggaggcccgtatcgagcgggcgggcatcttccagttctcaccggaggagggcacccccgccgccgagatgggggatcaggtggacgccgccaccgccgagcgccgggtggagctggtggtggagcttcagtcccgggtgatggacgccttcaacggggagcgcctgggcgagtgcctggaggtgctgtgcgagggctttgatgccgagatgggctgctatgtgggccgcacctatgccgactcccccgacgtggacggcaaggtgtacttcaccgccggcggcctggtgcccgccggggcgttcgtctgggtgcgcatcaccggcaccagcgacggggatctcaccggcgagatagaggagtgaagcaatgaataccgccaataagctgaccatgctccgggtggcgctgatcccggtgttcctgattctgctctatctccgcttccccttccacatgtatttcgccctcacggtctttattctggccagcgtaaccgattttgtggacggctacatcgcccgccactacaaccaggtcaccgactttggcaagtttatggaccctctggccgacaaggtgctggtcatggccgccctgctctggttcgtagaggcgggccgcttgcccgcctgggtgcttctggtggtcatcgtgcgggagttcgccgtcactgccctgcggctcatcgccgtggagcgggggcgggtaatcgccgccgcctggtcgggcaaggtcaagacggcctccaccatggtgtgcatctgcctgatgctgctcattgcccggcctgcgctggatctggtgtgcgcggcggtgatcctggtcaccactgtctactcgggcgcggagtattttgtgaagaacaaagatgtggtggactggagtaacctgtaatgctggattttacgaaagagctttgccccgaccggccgctgatccacccaacctcccagacgaaaaactgccggttcggccgctatgtggagatcggcgaccactgtgtgctggaggagaccgaggtgggggactacacctactgcttcggctccaacgacatcatctataccgccctgggcaagttcaactccattgccaccggcgtgcgcatcaacccggtgcagcacccggccaagctccgggcggcggcccaccactttacctaccgctgctcccactacgggctggggccggatgacgcggctttgatcgactggcggaggcagaaccaccgggtggtcaccggaaacgacgtgtggctgggccacaacgcggtgctcatgggcggcgtcaccctgggcgacggcgcggtggtgggcgcgggggccgtggtgacccatgacgtggcgccctacgagatcgtgggcggagtacccgcccggcacatcggctggcgctacccgcccgagctgattgccgccatggagcgcatccgctggtgggactggagccacgacatgctgagggagcgcctgcgggactttgacgacgcggcggccttctgccggaagtttgacccgcaatagaaaacgagggcccgttgctttcatccagaaagcaacgggcccttgcattaaaagacctgctggaatagattgaacaggaacgttagcaggggaatggcgttgatacctagcacaatagctaaaacggtcatccaaaagctcaacggctccctctgtgttcggacaggcggaatgtagatgggtgaggagacctcctcgcctaccacaattttagaggagataccgtacccggccagtacttgcaccaaccgctgggcctcacgcggcttcaggtgagtgaccagcaccgccggggcccgttccagcagggcttgcgcatccttctgagagaggcccagctccttggagagacagtgcagagcggccgggatatccgcgtgtgggcccagaccggtgaacacgagcgagtactgcctaggggcccgcttggggggagggaaactctggagtggataaccgcagtgaatgcaggccagggcttggtcagatacctcttttccgcactcaggacaggagatcaaggccataagatacctcctcttgtgtaaaagctgggggattccggttccataataacaggttaatctatggtttgcaaccgtactccgccttgacacatttcccggaacatagtagtatactagaacagttgaattgcgtgaggaacggaaatggtacccagcgagtaacccgccaaagagagagcgttaccggctgagagcgcgcccagggggtaactggggaatgtgtgtccgggagcgcgggggatatggatgccccacggctggccccgttaccgacctttgagtgagaaatgagagtggaaccgcgatttgtaccgcctcttatgccgtccggcatgggaggcgtttctgtttttcaggaggtgtttggactgacgcggctgtgccatccctgagactgatcacggcaccctggcggtctaccgcccggaggagtggctggagcgggtgcaaccctttttggaggagaccccggtcagccgaacagactggtgaacagcagactcagcagagaccagatgaccagggcggtgagtgtggcgaatacgacggaagtgaaggtcagggcatcgcccggcaccggagaggggagctggggcggctccggcaccgccccatccaccaactggacgggagcgcccgcccgacggaatacctccagcagtgcaagggcctcctcctcggtgaggccctcccgcaggggaaccggctcccggcgcgcttgctccagcagacgtatgccctgctccctggagaggcccagctccttcatgagggcgcggagcgttctgctgcgggcatccggataggcggggcgggcggtgaggcggacggtaaagcggttgggccctgtgatggggcggaagtccgcatacggtgcggcggaggagaggggatagccgcagtgaatgcaggccggagcccggtcggatacctcttttccgcactcaggacaggagatcagggccataagatgcctccttttgtgtgaaagcgtgtggtttcagccccatactaacagaaatccccctgaattgcaaccgcaaagcgccttgacacatttcccggaacgtggtagtatactagaacagttgaatcgcgtgaggaacggaaatagtacccagcgagtacccgccagagagggagcgtcaccggctgagagcgcgcccagggggtaactggggaatgtgcgtccgggagcgcgggggatatggatgccccccggctggccccgttaccggcctttgagtgagaaatgagagtggaaccgcgatttgtatcgcctcttatgccgtccggcatgagaggcgtttctgtttttcaggaggtgtttggactgacgcggctaggcgagaccctgcgggcctatcaggcccgcgacccggcggcccggagccggctggagatttttctgctctacccgggcgtgcacgcgctcatctaccaccggcttgcccactttctctaccggcaccggctcttcttcctggcccggctggtgagccagtggagccgctgctggacgggaattgagatccaccccggcgcgcagatcggccggcggctggttatcgaccacggcatgggcatcgtcatcggcgagacggccgagatcggcgacgactgcctgctctaccacggggtcaccctggggggcaccggcaaggaccacggcaagcgccaccccaccctggggaacaatgtgatggtgtccgccggagccaaagtgctgggccccttcaaagtaggggacaattcccgcatcgcggccaacgcggtggtgctcagcgaaataccgccggaggccaccgccgtgggcgtccccgcccgggtggtgcgcatcgccggggagaaggtggacttcgccgggcaggtggaccagatccacgtgaccgacccggtgcagaaggagcttcaggcgttgaattcccggctggaatggctggaacaactgatggatgaacaggcaaggagtaagaatctatgaaaatctacaattccgcaacccacaccaaggaggagtttgtcccccatgagccgggcaaggtgtccatgtacacctgcggccccacagtgtaccactttgcccacatcggcaacctgcgcagctatatcatggaggacgtgctggagaagctgctccgctacgcgggctatgacgtcacccgcgtcatgaacatcaccgacgtgggacacctggcctccgacgccgacaccggcgaggacaagatgctcaagggggcccagcgggagcacaagaccgtgatggagatcgcccaattttataccgatgccttctttgccgactgcaagaagctgaacatcaagtaccccgacgtggtgcagcccgctaccggcatgatcggtgactatatcaaggtcatctcctccctcattgacaggggctacgcctacttcgccggcggcaacgtctacttcgacacctccaagctggagaagtattatgtgttcaacgaccacgacgaggaggacctggccgttggtgtccgtgagggcgtggaggaggacgccaacaagcgcaacaagaacgactttgtgctgtggttcaccaagtccaagttcgaggatcaggccctcaagtgggactccccctggggggtgggataccccggctggcacatcgagtgctcctgtatctccatgaagtatctgggggagcacctggacatccactgcggcggcatcgacaacgctttcccccaccataccaacgagatcgcccagtcggaggcgtacctgggccacccctggtgcaaatactgggtgcatatccaccacctgaacaccaactctggcaagatgagcaagtccaagggggagttcctcaccgtctccctgctggaggagaaggggtatgatccgctggtgtaccgcttcttctgcctccagtcccactaccgcaaggggctggtgttctcctgggagaacctggacaacgccaaggccgcctatgacaagctggtggcccgtgtagccgccctgagcggtgagggaactgtggacgagggggccgtggagcggttcaagaacgacttccttgaggcggtgggcaacgatctcaacacctctctgggggtcaccgccctgtacgatgtgctcaaggccggcgtgaacgacgccaccaagcgggcgacgctggacagcttcgaccaggtcctgggcctggagctgctgtcccacgccgacgccctcaaggcccagcaggccgcccccgtggagggcgcggaggagatcgaggccctgatcgccaagcgcctggaggccaagcgcgccaagaactgggccgaggccgacgccatccgcgaccagctccgcgccatgggtgtggagatcaaggacggcaaggacggcaccacctggacgcggatctaagccatcaaagggaggagaccggaaaacggtctcctctttgcttcgcttcgtgtttacacatgcgccgaagggacttcccttgccaaacaggcggaatatcggtaaaatagaaccactatagcggattcaagcgcggaaaaaggggggagaaggacggagaggcagacacagaacgacttttccagggggagcatggcgcggaacatccttcagatggcgctccccatgacggtggcgcagctcatcaacatcctttataatattgtagaccgcatgtacctgggccggttgccggggcacctgtccctgaccgggctggggctgtgcctgcccatcatttccatcctcatgggctttgccaacctgtgcggcatggggggcgcgcccctgtgctccattcaccggggcaagggagagaacgaggaggccgagcggattttaggcaactcctttaccctcctgctcctgtttggcgggggactgacggtgttctgcctggccttccggaggcccatcctctatctctttggggccagcgacctgaccttcccctacgccaacgactacctgaccatctatctgctgggcaccctctttgtgatgatcggcctgggcatgaacccctttatcaacgcccaaggcttcagccgcatggggatgatgacggtggccctgggggcggcggtgaacatcgtgctggatcccatcttcatctttgccctggatatgggggtgcggggggcggccctggccacggtgctcgcccagggctgttccgccctgtgggtgctgaagttcctcactggacggcgggcgctcctccggctgcggtggaacaccctgcggctccaggcggcgcgagtacgtcggatcctcgccctgggcacctccggctttgtcatgtccatgaccaacagcctggtgcaggtgctgtgcaacgcctcccttcagcactacggaggcgacctttacgtgggggtgatgaccgtcatcaactccatccgggaggtggtgtccatgccggtgcagggcatcaccaacggctgccagccggtgctgggctacaactacggcgcgggggagtacgagcgggtgcgccgggggatccggttcaccacggtgcttacggtgggctactccgtggcggcgtgggcgctggttatggccgtgcccgagctgctcatccgtatctttaacgacgagccggagctgatcgctgcgggcattccggccttccggctctatttcgccgccttcttctgtatgtccttccagttcatcgggcagtcggtgttcgtgggactggggcgctccaggagcgcggtgtttttctccctgctgcgcaaggccttcattgtggccccgctgacgctcctgctgccggggctgggcatgggggtggacggggttttcgcggcggagccggtctccaacgtgctcggcgggctggcctgcctgctcaccatgtatatcacggtctaccggcgtctgggccggtaagaccgggggcggatttccccagagggaaattccgccctctttttttgcccggcctgagatattttccgccgcccgcgggtattctcagtgaaaggcctttcaagagacgaccgcaaggaagggagtacccatgacagaagagacattcgagcgggtggcccgcacctacggggacatgctctaccgggttgcttaccacgctctgaagaaccgggcggacgcggaggacgtgacccagaccgtcctgctcaagctctaccagcagggagaccgctttgagagcgaggagcaccggaagcactggctgctgcgggtggcggtgaacgagagccggcgcctgctgcgctccttctggcggagccgcgccgtgccgctggatgggcagtgggacgcgccggtgtccgatgaccccgccaaacgcgagctgttccaggccgtcatgggcctggagaccaagtaccgcctgaccatctatctgtattactacgagggctgctccgtcaaggaggtcgccgcggcccttcatgccaatccgtccacggtgcagacctggctccagcgggccagggagcggctgcggagggagctgtccgaagaagaggagggaaagggctatgtttgaacccaatcaataccgtgaactctgctcggagctgcatgtatccgaggaaaaattagaggaggttatccaaatgactgagcaggaaaagaagcgcaagttccaccgtcccatgcgtctgggcttggtggccgccgccgtggccgccatgctggtggtaacggtgagcgccgccaattctgaggcaattatgacctatctcacaagtctccgcgacgccgcggtcgccggggaggcctgggcggattcctcggtgaatacggaggaggggacgggaggactgtgcctcccggaggcgtccctggaggagcgggacggccgcaccatcctgattgtggacggagtggagaccgatgtaacccaggcgctgaccgaccaaggggaatacctgtatgagtgcggcgagggggaggaacaggcacaggtacgggtctatttggacgagcagggcgcgccccggctgatgaccagctttttcacggccggagaggacggcggaacgggggcggtcgtggttgtcccggcggagggggagaagtaaggaaacgcccccatagagccggattggctccttggtgcgctccggattgttgactcaaataattttaaatgtcatactgctccacggaaaaaaccaggcggcccaaggaattgggccgcctggtgctgttcgtatttttgactaatttattgtagtatggtataatattatatcattgaattgctccgggcgcgcccggggacaggaggctaccgcatgaaactcatggtcattgacggcaattccctcatcaaccgggccttttacggtatacggatgcttaccaccaaggacgggcagcccaccaacgccgtctatggctttgtcaacatcctgctcaagctgctggacgaggagaagcccgacgccctgtgcgtcaccttcgaccggaaggcccccaccttccgccacctggcctacgagggctacaaggcgcagcggaaggggatgcccgacgagctggccgcccagcttcccgtgctcaaggacgtgctggccgccatgaatatcccccgctacgagctggacggctgggaggccgacgatctgatcggcaccatcgccgccagggataccgccgccgggtgggaaaccgtgatcgtcaccggcgacaaggactcactccagctggtcacggacagcacccgggtcaagctggtgtccacccgaatggggcagaccaccacgaaggagatgaccccggagaccttccaagagacctacggctttgcgcccatccacatcgtggacttgaaggcgctgatgggggacaccagcgacaacattccaggcgtcaagggcattggggagaagaccgcgatggatctgatccagcgctaccagagcgtggaggccatctacgccgacgtggagggcgtggaggccaagcccgcggtcaagaaaaagctggccgagggggaagaacaggccagaatgtcctatgatctggccaccatccgctgcgacgcgcccatcgacttttcccccgaggacgcccggcggcgggagccggacggccccgccctgtacgagctgtttctggcgttggagttcaacaagctcatcgacaagatggggctgagcggcggcccggcggccggacgggcggacaagcccgccgccggggccgtccggcaggagcgcgtcaccgaccgggttcgcatggaggagctggtggagcagtggcggagggagccgtgggtcgcggtgctggccctgccctctctggatgtggtggcggtggcctgggacggcggagccagggctgccctgtgcgcggcggaccggctggaggggtacaatgagctgctgcgggccctgttctccggggagatccaaaaggtgtcccacaatgtcaaggatctgatgcacctgctgctggacgagggactgagcaccgacgggttctgctttgacaccgccctggccgcctatctgctctctcccaccgacggcagctacgagctggagaagctgggtatcacctattttaaccaggagttccccaaggcaaaggagtacctggcccccgacgctttcggccccctggccgacccggcgggaccggcggaggccatgtgcgcccacgccgccttggcggccgcgctgtatcgtgccctcgcccccaagctggaggagctggacatgcacgagctctattacgggctggagctgcccctctgtcccgtgctggcggaaatggaacgggcgggcatgctggtggaccggagggcgctggccgacttcggtatcctgctggacgggcgtattcaggccgacgaggccctcatctacgagctggcgggggaggagttcaacatcaactccacccagcagttcggccgcatcctgtttgacaagctgggcctgcccccagtgaaaaagaccaagacgggctactccaccaacgccgacgtgctggagaagctgcgggacaagcaccccattgtggaggcagtgttggactaccggcagttggccaagctgaaatccacctatgtggacgggctgaccaaggtcatcgccgccgacggacgcatccacacctccttccagaacaccgtcaccgccaccgggcggctgagctccaccgagcccaacctccagaacatccccgtccgcaccgagctgggggcggagctgcgcaagatgtttgtggcccccgcggggagggtgctggtggatgcggactactcccagattgaactgcgcctgctggcccacattgcgggggacgagcacatgattgccgccttccgcaccggagaggatatccacaccgtcaccgcctcccaggtgttcggtgtgcccccggagcaggtgacccacgagatgcgccgccgggccaaggcggtgaacttcggcatcgtctatggcatctccgacttctccctgtcccaggacatcggggtgacccgggcggaggccaaggcgtatatggagaagtactttgagaaatattctggcgtccacgcctatatgacccaggtggtggagcgggccaaggccgacggctatgtgtccaccctcatgggccgccgccggtggctgccggagctcaagtcctctaacttcaacctgcgctccttcggcgagcgggtggcgctgaacatgcccatccagggcaccgccgccgatctcattaaaaaggctatgctccgggtggacggccgcctgcgccgggaggggctggaggcccggctggtgctccaggtccacgacgagctgatcgtagagtgccccgagggggaggcggagcaggtgcagcgcctgctggccgaggagatggagcatgtggccgagctcgccgttcccctcaccgccgaggcccacgcgggcaagagctgggcggaggccaagggctgacggagaaaggagcatgtatggattatctcggaatctgcctgctttcagcggcgatcattgttctagggattttcatggtgcgcaagccggactggtgctggaagctgaagcacgctctggacacagaggggggagagccgtcgaagtactatctggcgaccgtaaaggtgctggggacggccatgatcatcatcccgacggtggtgatcctggtttccatcctctccctgattttggcggctgtaggcttgggatagcatgaaaggggaggagctttaatggatctgcgccccattcccgcccgggactgggcggactggtacaccggggagctgtgcgcctcctttcccgcctgcgagtgcaagccgctggaggccatccgcgccctggcggcggaggggcgctatgagctgctgggcctctgcgatggggcggccctgctgggctacgccaccctgtggagcactccggagtggccggactatgtgcttctggactatctgggggtgaccgccgcccgccggaacggcggtctgggcggggccatcttgaagatgctggccgcccgggaggcggggcggcggacggtactcgtcgaggccgaggcggagcgctccggcggcccggaggaggagcggcccctgcggctgcgccgcctggggttctatgcccgaaacggctgcatccccgtgtatgagagcttcaactgcggcctgctctgccaggtctttgtgctggggcccgccccggcggatcaggtggacctcaaggcggctcaccgtgccatctacggcccggcccggacggacgtggtcatagacccgccccccggcgcgtcgccggagccgccctactggatgtaacagaggtgttgacatgatacaattgcaagtgtgtttctgcctgctggggctggcgctggccgcgctgggcgtggcgatgctcctccggccccagaggctgcggcgcttcctgcggcggctggacgcccggctgtggaagtggacggggcggcggctggcctggagccggctggccggcagcggcctgctgctgctgggcagcgtcctgttcctggtgctgctggcggccctgctgctgcgggcgctctactgaggggggcggagggatgaactacaggctgattcccatggagcgggcccatctgccccaggcggcggagctggagcggcagtgcttctccgatccctggacggaggcgcagctggcgggtgagctggacaacgagctgctctccctgtcggcggccgtgggggaggacgggacggtgctgggctacgccgaggtgcgggtgatcctggacgagggtaccctggagcgcatcgccgtggccccccgataccgccgccagggcatcgcggaggccctgctggacgcatacatacagtacggccgggagcacctggccttcctcaccctggaggtgcgggcgggcaacgcccccgccatcgccctctatgagaagctgggcttccggcaggtgggccgccggaagaactactaccgtgccgagcacgaggacgccctgctgatgacggtggagtttgaccgccatggctgagctgcgtctgctcaccgcccggcagctccggcaggtgtaccgggagcgggtacggtccgattttccgcccagcgagcggcggcctcttgcctccatggagcgcctgcgggcggcgggggtatacgacacctgggggatgtacgagggagaggagctgctggcgtacgctttcctgtggcggtcggaggcgtacggcgtggcgctgctggactatctggccgtgtgccgggagggccgggggcggggaaccggcaccctggcgctttccctgctccaggcccgctatgggggctgctccctgctggtggaggcggaggcccaggaggagggggtgccgccggaggaaaacgccctgcgggccaggcggctgtccttctatgagcgctccggcttccggcggctggactaccagacccggatttttggagtgcaatacgccatgctggtgtggccggaggaggccgcagcagagccggagcggctccaggacgcccaccggggtctgtatcggagccagctcccgaacccgctgttccggcgggtgatccacattccggcagacgagcactgaggcggagccggctttttccgccgcctgatatgtacctgacgatcccgcaagaaaggactgattcggatgaatatcctggcctttgaatcctcgtgtgacgagaccgcggcggcggtggtgcgggacggccgcaccgtgctgtccgacgtcattgcctcccaggcggatatgcacgccgtctacggcggcgtggtgccggagatcgcctcccgcaagcacgtggaggccatcgccggcctggccgaccaggccctggcccgggcggggctgacccgggcggacatcgacgccgtggcggtcacctacgcccccggcctcatcggtgcgctgctggtgggggtcaacttcgccaaagcggcggcctatggactgggggtgccgctgatcccggtgcaccatgtccggggccacatcgccgccaactacatcactcaccccgagctggagccccccttcgtctgcctgtgcgtctccggcggaaacaccatgctggtagacgtgagggactacacggacatggcgattttgggcgctacccgggacgacgcggcgggggagtgctttgacaaggtggcgcgggtgctgggcatcggctaccccggcggcgcgcccatggacgctctggcccaggggggggacgaccggcgctatgagctcccccgcgcccacgtggccgacgcgccgctggacatgtccttttcgggcctcaagacggcggtgctcaatctggcccacaacgccgcccagaagggggagacgctggatctccccggtctggccgcctcctttgccgccgcggtgagcgataccctggtgccccgcaccatggaggccgcccgccggacgggctatggcaaggtggccgtggcggggggggtggcggccaacagccgcatccgggccgatctggagcgggcctgccgggccagcggccacaggctctacctgcccgccctgtctctgtgcggggacaacggggccatgatcggctgccaggcatactacgagtatcaggcgggccgccggggggatctagccctcaacgcctatgccacccgctccatcgagcagggctgagagaaaatgcaccgccccggaaaccaaggtttccggggcggtgcatttttgacagagggcggcaacgggatgcaaaattgtgttatgtctactatgactccaaagcggccaaaagtggggacttcggttgaagcatgtggataactgggtggataagtgcataactgactgggacgctaaggaggagagggggtggaaaacccggtggacaatgtgaataactctctgtagaggcgctgagatgggtgaattatgtcaaataaatggagaaaaaatccagggggaaatgggggcgaaacagaaaaaacagggcggtgactgactggtttttcgtctgattgggccttgacaggcgggcagagcaggggacacacccggcccgcccggcaggaaatttgcagcttttccgccgcggggcagaggcgtatacaatgggtattgaacaggaataaaacttcatgcgccacgggcgcaccacgaacacaggcaaaagccggggcgtatgaagtttttgcgcatgtgggccgtcccggcccccgcgcttttaatttcatggccgtgccgctgaaagcggcacatggccaattttgctatgcttttgcatagcaaaaaagcggccgcagcgtacgctgcggccggtagaacgtgggagtagctcaggccagcttggacttggccagctcggtcagggtggtgaaagcggccttgtcgttgacggccagctccgccagcatcttgcggttgatctccacaccggccttcttcaggccgttcatgaaggtagagtagttcatcccgttcatcttgcaggcggcggaaatgcgggtgatccacagggagcggaagtcgcgcttcttcaggcggcggccggtgtaggcgtaggacagggacttcatcacctgctcgttggccatcttgaagtgcttgctcttggcgccccagtagcccttggccagcttgaggaccttatttcttctcttgcgcgtcatcatcgcgcctttgactctagccattgtaaaaagcctcctatgttaaggtaaaaatcagtcttatcttatttgtaggggatcatgcgcttgatggcgggctcgttggtcttgtccgcataagcgccggcgcggaggcctctcttgcgcttggtgtccttgtcgtgaccgttgagcaggtgacgcttgttggcgtgggcgcgcttgaccttgccggacttggtcaggctgaatctctttttcgcaccgctgtgagtcttgagcttaggcatggtggtaaaactccttttctttcaattcaaaacgtgcggggttcaggacttcttggcttccttggcaaccttgggggagaggaagatggacatgtgccgtccgtccagcttggggtccttgtccaacgtggcgacctcgccgcactgctcggcaaacttgagcagcaggcccttgccgatgtcggtgtgagccatctcgcggccgcggaagcggaccgtgaccttcacccggttgccctcggccaggaacttctgggcgttgcggagcttcacattgaagtcgttcacgtcgatactgggagacatacggacttccttgatctccacgacgtgctggtttttccgcgcctccttctcccgcttggtctgctcgaacttgtacttgccgtagtccatgagcttgcagacggggggattcgcagtgggagagatcttcaccaggtccagattcgcgtccatggcgcgctccagcgcctcccgggcggacatgatgcccagctgctctccggtgtcggagaccaggcgaacctccttgtcgcggatctcttcgttgatttgatgaccctgtttgctgatacgaaagcacctccaattctcagatacatacaaaaaaacggctaccagtccggtacccgcatccaacctgaacacgcacgcgccgcatcgggcgcgcacgggaaacctgattgacctctttgccgtgggctggaggtgaggatgggggcaccgatcctgctttgttttgctctgatagtatagcagaccgttggcgtagtgtcaagagaaatttcaaaggcccggttggggcttccctttttcggagaaatgtggcaaactaggggcagaggagggaatgagatgcatcatccgattcgcatacgcgcgcttcggctgggcctggcggcctgtctgctggccggggcgctggccggactggcctctgctaacgcacccacttatgaaacgacgattctgttcacccatgacacccacgaccacttcctccccatgccggatgaggagggcggggaatacggcggctatacccgtctggccaccctgatccaacaggagcgggcggcccacccggacgccctggtcctggacgccggagatttttccatgggcagtttgttccagaccatctacgccacggaggccccggagctgcgggccctgggcgcgatggggtacgacgccacgacgctgggcaaccatgagtttgactaccgcgcccgcggcctggcggagatgctcaacgccgccgtggagagcggcgatccggtgccccccattgtccaggccaactacaagctcccggcggaggacgcggacacctgggcggcgtggaaccgctacggcatcggggactacctgattctggagcggggcggcgtcaactacggcattttcggcctgatgggggaggaggcggacagcaacgcccccatgtcgggcatggagttcgagcccgccgccgacgcggcggagcgcaccgtggcctccctggaggaagagctgttgtcccggaacgctccctattttatcatctgcctgtcccacagcggcaccgacggcaggggaaagggcgaggactacgagctggccaggcgggtggacggcatcgacgtgatcctctccggccacacccacaccaccctggacgagcccctgcgtgtgggggacaccctgattgtgtcctgcggggagtacaccgccaacctgggcgtcctcaccgtggagtggaagccaaacggggagaaaaccgtgaccgactaccgattgctccccgtggacgagacggtggcggaggatccggacatggtggccctggcggcgtccttccgccccctggtggaggagcagtatctggacgactacggcgtaggcttcgatgaggtgctggcgacctcccccttcgcctttacccccatcggtcagttcggcgcggagcaccgggaggacaccctgggcagcctgattgccgactcctacgtatacgccgtgcagcaggcggagggggcggactacgtgccggtggacttcgcggtggtggccgcgggggtgatccgcggctccttccccgctggggagatcaccacctccgacgtgttcaatgtctcctccctgggctccggggcggacgggacgccgggctatcccctcatctcggtgtggctgacggggaaagagctgaaggacgcctttgaggtggacgcctcggtgaccgctctcatgccggaggcccagatctacggcgctggcatgacctggacgtggaacccccgccggatgatcttcaataaggtaaccgactgcgcccaggtgctgcccgacggctccgctgttcccatcgacgacgaccggctctaccgggtggtgaccggactctacaccggccagatgctgggcaccgtcaacgaccagtccttcggcatcctggccatcacccccaaggacgcccagggcaatgtgatcaccgactatgaggagcacattatttacaaccccaacggctccgaggtgaaggagtggtacgccctggcctcttacctccagtccatgggagaggtggatggccgctatgccgcccccgaggggcgcaaggtagagcacgccacctggaaccccctgagcctgctgaaaaacctgaacctgtttggctggctggccgtgctcgcggaggtgctggtgctggccgcagtcgtgttcctggtgtggcggctctgctttcatcaccgccgtggccgctacggcggcaggcggcggggcggcggctaccggccctaccggggataaaggaagagagaatatataaggagaacaactacgacaacccggggttttttagccagtaccggcgcttcccccggtcggtggagggcctctccgccgccggggagtggcacgcgctgcaaaagctgttccccgacttttccggcaagcgggtgctggatctgggctgcggcttcggctggcactgccgctacgccgccgaccacggggccgcggcggtgatcggggtggatctgtccgagaagatgctggagaaggcgcgggcggacaccttcgacggccgcatccactatgtgcggggggccatggaggaggtggacttcccgcccgcctcctttgaggcggtgctcagctccctggccctgcactatgtggaggagctggggccggtgttccgcagggtgtgggactggctggcccccggcggggactttgtgttctcctgcgagcacccggtctttaccgccgagggctcccaggagtggtacccaggccccggcggtgcgcccctccattggcctgtggaccgatacttcaccgagggccgccgcaccgcccgcttcctgggctgcgatgtggtcaaataccaccacaccctgaccacctatgtccagaccctgctggagaccgggtttgtcctcagggcactggtggagccgaagcccgattcccggctgatggacgtgcccggcatggccgacgagctgcgccggcccatgatgttgctcctgtctgcccataagccggaataaaacgacgagagccgtttcagacagagaacatgtgctgctggtgccctgtttggagggagtgcaacccggagttgcggatttgagtgcaggtggtaggtggtatgcagccgctgaaacatgcatgatttaagtacggccggtcacggctgaacttaaggaggattcaaaccgtaagtgtatcaaagcagctcattcatctgagaagcatataggggatctcccaggaggagttggcctctttgatgaatggaaccagataggcggtaccgaaatgggagaccgacctttcacatactttaaaatatagatacagaaaccgctcccacacttgggaagttctaacagttgcccgacaataaacgatattcggcctccgtcctgctccatgagagaggcaggacagggaccgggcccagaaagtgaaaaaagggcttgtcaattttgctctgactgggtaatataggagccaagaggtacagaaatattgcgtcggatcccaggtgtagcgagcgcctgaggccctatgtgggtgacacgaccacccatacaacggaaaatccgtactacgctgttgttataacctttcctgccccattctggcaagagggttttagcggctgtgttgcagactgatatgctgtgtggggatatacataccccgcacagcattttttgcctcttgcggaagggccaacagggggcagccgccccccaagggtcccgacgcaagagaagcaaaagcacaggaggccgctgatatgaagaaaaaagtcaccgacttatcccaggcgctggccgtgggcttgcctgtcccggccagcgccgcaggggagaccttttccgacgtccccgccccgccctgggccgtccccgcagctccggagtggaagaacggggggaaggctgctccgtccgatccgtatctcgttccacccctttgaaagtgcgtattcaaccagattgccccccggcatagtgttccactcgtactgtccgcagaggacacaggtaaggccgtgggcctccgctatggccttgaatttcccggcgcctccgtcctgtagtaattgcgtcagcaagtctcgcttgcgagcttgcttgattaccatacgacacaggcgaaacaggccgtcaagactggtgtagccacttgcgaaaaaactgccccgactcttacgaaaccgggacagacttttttcggtcctgaccgcctgaggcggctgtggcacggtgggcattccctacactgtgtaatccctcagtacggaggctttctgctcagcgtccaaacaatacttaaacaggagcagtaagttcagctcctcccggcgataaatagggcttttcgggatgccatcccctgtgatatgtgtgacaacggcgaacatggattgaaagctatcctcattccattccagctcccttgcctgcttctccgcaagctgggatatgcgttccgcggactttgaaattttagatcggcccctgttccaaattgccagccattgaaacaggtccggggaaaaaagtttatgattgagttctcctactaaaaaagacagcttgcgctggttgattgcttctgttatgtgtcttatgcggtcatcctcaaaggtactgatagccttcctgaaagcaatatcatagctgtcaaggcttttacaggcggccagattatcaagcaatatttgtgcgattgtgggctccatatggagcatggaagccctcagagcttctatggaaatttcctgtgtataggtatcgagataagctttcctttcgtattcccgataaagccgctcaatctcgcttttgacctgttgctgtccctttctgatggcattctcattcgtcctgtcggatagaacggcgctttcaaatgcggctgtcactatgtctatacaagtctggcactccatatcaggccaagtccggtcatacagatagccgccgatggtttcctctccatactccacgttttcatctgcccatcctttacggcggtcgttgaacgactccgcaagtgcggatttaaggtttgtgaccgataatccgtggcggtttccgatttcccggattgtaggtcccaaacgcctgtcaagcgtgtcctttttcttcatcggagaacactcctaaaattataataaaaatatctaatttcgatatagtgataagttaaaatatccctggttttcacagtgtgatccatgcgagaatcaaaatgtgcgtttttagtatattacaaagcaaagtgcgtgtgaattttctgcttttgtctgctttcctggtcctgcatagagcctttctccagaggtgggaaatagtagaataattgcatatctagagcggagcaagcgtccggtcagtgcggcatggaagaagattgaagcccgccctctgacggacagctgcgatctggaaaatgaaatttaggcatcaactataattgtcttttggagcggttatggcggcgcggagagcggcatcccatcggcagccgacggcaggccatgatcgccggcaaatacggcggcgtgttttgcaatctcccggatgggaccgtgtgcatgtgtaattactcctaccagcatgaggactccgatttcctggtaggagacaccgtgattctggtagtccagcggtatgcggaggagaaaaagcagatgtacggcaaaatcctctcgaagtggtgatccaaaagcgaacaggcccgcccctttatagggggcgggcctgtcacctttactaactcaaaggtccatacccatattattttgtgaaggaaggtcagattgacatatgaaagtgagacgactcgttgccttgtgtacggcaatgttcctcagcctacagatggcggagctccccgcctccgccgcgggcagattttccgatgtccccgccggttctcccttttatgagagcgtgacctatctggcggagtgtgggatcacagccggtacgggcggacacagtttcagcccggagcgtcccatcacagtccgggagtgggctgccctgctgttccgggctttcgatggaagtaccttgtcctgcgattccccaaaggagcggtccgagctcagtatccagcggtgctatcaaaacggctggctgggcgtgagtgctgccatatcccctgatgggactctctgccgcggagaactgctgctcagtgccttccatgcggccggactgccggtatacaacgcctctctctatggctatgaggaggcaggatgtctccgcaggaaaacgcggtacgcattggaaaggaacttggactgtgccccgaagcggccgcaccatttggagtgcagttgcttccgtctctcaatagaaaaatctttcaatcgacgatctatggaagaaaaaacagcagcaggatgctccatacgagcagtattatggcacaagtccgtaggttctactgatagtaggtctgggagagcgtgcaataaactacgaatgcgattagcaattatgatttatttggggcgataaaaattttggaagccccttcagcaatctgaacttcatatcgctgcccacgataataaaagtgaaactgtatggatacaaggccattggggagatgaggggacaactttggaacgccgttctcgatatgcagtccggcaaagccaaagataactgtattccaagtctcaccgagacaggccagatggagcccttccttgcccgtgttgcccataacctcctccaggtccagatagagggccttccgccagtaggcttcagcggcctctgccaggccattctgggccgcaaagagggcgtggctggcaaagctgagggtggagtcatggatacacaggggctcaaagtcctcccaggcggccagcttttcctcttcggtaaactgctctggcagacgggttataaggagcagcgtatccgcctgcttgatcacctgatagcgttggagccggtcgaagcagacctggtgatagctggcctcgtcgccggatttgagctccgccggctcaacgcgctccagcaggtggaacgtatcgtcctggcggtagtggccggtgattggatccctgggaagctggatggcatcgcgtagtatctcccaagcagcgcactccgctttggacaggctcagggccgcatactgctccggcgcctctttcttcagccgtgcggcggcggtcagcgccagagagagattgtgctttaccatggcattggtgaaaagattgttgctggtaatgccgcagtattcatccgggcccttgcagaacagcagattgaccttcccggcttcgggggcgggagagtaacggctgacccagaagcgggctgtctccaccaacacctgtgcgcccccctggaagaacaggcggtcatcgccggtccaatccaggtattggcccagagcataggccacgtcagcggtgacgtggacctcgctgcaaccgatgtcccagctttcacactgctcggtgccgtcataagacaccatccaggggtagcgggccccggcgccattcatccgcgccgcatgcgctctggcctggggaagcgtgccgacccggaagcctgccagactgcgggcagcctttggatcggtcaggtcataaaagggcgtcagaaagagatctgtgtcccaaaaatagcagcctttgtaccgcgtgtgggtgagccctctagccccgatgctcacggtgtggtcccggggagagcagttggccgccaactggtagatcacataacgcagcgccgtctgcgcgtcgtcatccccctccatgacaatgtcgcagtccgcccacttttgctcccatgcggcctgattctccgccagcgcacttacaaagtcccagcctggctccacatccagctggagcagggaatccacatcgcggctggaagtcagccgggcggcgatctccaaggcgatgggagcatcggaagcgtcactggtgcagcgcactcccacgccgtcaccggtatctgcaacaaaagcgggggatgaaaagccctctgtgcggcaggaaaccgtctgagccagttccagccttgtatgatttgtcttatagcgggcggtgaatccggcgtcggtcgcctcgccggagcagaaacgggtcatctggatgatctgggtgttctccttcacctgatcgtctgggatagggctgttgcagctctggtggtcgatcccggccaaaagctccacctgcccgcggccctggaattcaagccgctggaacagaaagctaggcttggccaaggagaaaaaacgctgttcctgcacatccacccagtcatccgcaatactcagccggtaacggaaggtgagcagacctgtacggagatccagcgcgcgggacaaatgggagggaatggccggtatgcggccattcaatcggatctggtaccagataggggtgggcagattgacaaaatccgtcagctctgtgctgtcggagatccggtcataaaagccagccaagaaaagtccggcgtccaacggccggcggatcggccggtaagcggggtaaccccgggcccccatgcggccgttgccggtaaagaagacgctctccaggaagcggtcggcaagatcgttcccctccgctgaaattgtccagccccggcgcttcacgtcagttctcataggacacgcctcctaacgcataccgcagggcgtggcacacaaaccccgcgcaagtggcaaaggcgtctcccgtcgcggatcggcccgtgtgctcattgatgctctcacagacgatgccgttgtccatcaccgcccggcgcagaagatccagcgaccgctccgcctccccgctgagcaggctgttggccacactcaacatccagggatggggggcgtgggcgcagccgatttccgcaaaggcgcacccggcgaagctgtaaggatactccggggcgcggatttgacgcaccgtattctgatatgcagggtcatccagcgcgcagaagcccaggtagggcaggagcagcaggcttcccggcggctcgtcatatacatctgtatggccctccagatccgtggaccaggcgtagtatgggccgttcgggccctggacaacacagtgctccaggatcgaccggcggacctcctccgcctctacggcaaggtcgccgtatgtttcgggatacagggaggacagcgcgcgaagcgccttccataccagcacattgtcataggtcaggtaggggtagctgcgcacgtcatcggtgggctgaaggaaggtctcgtacagtgggatcgacctgtgccgtttggtgcgcaaggtgcgcagaatatccgtaagcccggcgcggatcgcgttgtcctccagacagtcccggtcgcctgtggcagccgcatagcgctccagggccagcaccggggccatcagttcatccagctcaaaaccaggctccaggactgtgccgtcgatgtaccgcgagtggacgcccaggttgcgccgctggcggccgaatacatagtccagcatccggcgggccagtgccgggtcggcgtccactaccgtaggaaagctccacagcaggctgtcccggtcccagtaagccgcgctcacatagtagcgcgggctgcggctggtgaccagaaccagctcctcggtatccaaggtgatcccggcggagtagaacaggcagaagaacagattggtattgtagaggcgctccaactgggcatccggaatgggccagcggcgggcgtccagccagtctgtggtcacctgtaactcgtgctgccagccttggcgcagcatctccttggcgctggtggcggccgccacctcctcaaagccgaccccccagtagaaggtcacagtaacagcttctccgggttccagcgtgcaggcgtgggccagacggtagacgataccggcatccgtctcctgaaaggtggatgagcagggctgatccatcatgggcgcaaaagcaaagaggggcagtccgcagcgcatatcaaagatcagactgtcgttccaaaggctggtgtagcatctgcgcgccccgtcgatctccttgtcttcgttgacgcagtgccatgcggaggcccagcacccttccagaccgaaagtagaggacagcggcttatccgatgtggagcgtactgtcagctgatagagaaaaccacgttcccccaccggagccagaagcattccctccaccgctagggagccggccgtgccgcagaaggtcggaatccagtcggatttccgtccccaggtcagagactgaagcgaggccctttctccttccgtctcaaaaaaaggcgtcatcagcgggagagaagcgccgcccctctgctcgatcaggcccttatatcccatgtgcaggaaggaaaaggactccagcgccccggtgcgggcctggagagtgggaagagagacccactcgttgccggtaggcaaataacactcttgcatagagatccctcactgtcggatttaatcggttaaaccattggcaatctaactataacatattttgggcgcaagtcaataattgttttgtgaaaaatgttaatttatatcttgataatagagttgttattggctattatttgcttatggaatagtttaaacgattaaattaaacgaggtggtatagcatgtcggccaatcgggtcaccatgagggatgtcgccaaagaggctggcgtcaccagcgcggccgtctcttatgcattgagtgggaagcgcccgatttctgaggagacacgccggcgggttgagcaggccatcgagcggttgggttatacaccaaacatggcagcccgtaccctgggcagcgccagacaggattccaggctgatcggcgtagtggtccctcagaccgaggctggaagccgactcatgtttcagaaccagttttactctgagatattgggaagcattgaactgtgcgccagacagaaaggctaccatgtgatcatctctgctacggatgccaacgagagctatctgaccctggcaaaggagcgcaatctggacgggatcattgtcatcggcatgtatccggattccttctaccagcagatgaaggagagccggatccctatcgtattgatcgacagctattgcaatgaccactattaccataatgtacgcatcgacgatgcttacggcagctatctggcgaccaagtacattttggactgcggtcaccgtgccgtcgcttttttcagcggccgcatcaaggaaaacggcgtcatgaagaaacgcctggccggctatcgggacgctctggcagagtatgagcttcccttccgagaggagttggtctttgaagggaacattgactacaaagacggcatcgcgtctgcccaaaggctcatggacgcgggactccctgccacagcggtggtagctgcggcagatattctggcaatcggagcggcaaaagctttctatgagcgcggtgtcaaggtaccggacgagatctcccttatggggtttgacgatctggagattgcgcagtacatgaccccgggactgactaccgtaaagcagcagatctcagcgaagggggaaaaagcggtggagctgttgatccgcaatatcaatgagccggagttgaccaagcaggagttgatcctgccggtgtccctggtggagcggggctctgtccgcaagatcaaaacggagacaacctgaaaaggtctcaatatagggtaagaatggaacaacacatgtcttaattttgaaaaggaggaaccatgcaatgaaaaagcggtctctggcgatcctggccggcggaatgtcgctggcgctcctgctctcatcatgcggcccgtccagtgctccgaccgaaagcccatcttctgcccctgctgatgaaaccggccagcagacggctgaggagcctgtgaccatcacttactgcaacttcaacgcgtccggcggcaatgaggaaaccctgcagaaaatgtacgaggccttccatgaggaatatcccaacatcacggttgagatcgaaaccatcgccatggatgactatttcacccaaatgcaaacccgcgtggccggcggcacggcacctgactgctatgagctgaacatcgagaatttcgcctcctatgccaataagggcgtgctggccgagatcagcggtgtggacctcagccgcctggacgagactgcactgagcgcgttcaacgtggacggcaagcagtacggcctgcccggcaacttctccaatgtggtgctggtctacaacaaggacctgtttgaccaggccggcattgattatcccaccgcagactggacgcaggatgatgtgcagacggcggctgaggccatccgcgccttgggcgatgatatttacggctactaccagcctcttacttacaacgagttctacaaggtttgcgcccagttcggcggcagcctgctgaatgaggacaagacggagtttaccatcaactcccccgagaacgtggccgccgctcagatgatggccgaccgcgtgctggtcagcaacgtccagcccacggacgtgcagatgggcggcatgggtgactgggatctgttcatgagcggccgtctgggcatgatccccaccggtatttgggcattccagtcctttgccgatggctgtggctttaattgggatatcacgattgagcctggtcaggagcaaaaggccacgcacttcttctccaacggcctggtgatcaatgccgacagcgagcacaaggatgccgcggctacttggatcacctggctggcctccagccccgccgccgctgagatccgcattgaggcgggctgggatctgcctgccgtcagtgacgaggataccctggcctcctatctggacatgacgccgcccgataaccgccaggctgtgtttgactccttggactatctggtggtaccgccagtgatcgaggactatgccctgatgagcgatatcattggtcagaagctgtccgccgccgccaatggctccataaccgtacaggaagccctggatcaggcgcagagcgaatgcgaggcgcagatttcccttagctgataaggggtaggggaggggcttgtgcccctcccctgttcgattttctgaggaggtgtttcccaaccatgttagtcaaacggaagcggcgaaagggacccgggcaggaggggctgatcaccgcgtctccctttttgatgcccagcctcattggcttgctggtattttccctgctgcccttgctcatatccgcctttatcagcctgactgactggaacggcttggatcagttgacggcccccggcttctttcaggagcattttatcgggttggataattataaagccattctctccagccccgagttctggggggtgctgtggaacaccttccgctatatcatcatgtacattccgctgatgctggtggcgtctctgggggtggcctatctgctcagccgccagcgccccggcgtaacagccttccgtatcatctactatatcccggtgctcacctcctgggtggcagcctccatgatctggaagtctatgctatccccggagtatggcgcggtcaacaacatcctggccgttttcggtatacaggggccgggctggctgctggacgaggcttgggccatgccggctatcgtactggtgtcggtatggaaggatatggggttctttggcctcatcctcttgtccggtatggtgggcatcaacaagtcctactatgaggcggcatcgctggacggcgcaggctcttggcagaagttctggaagatcaccttgccgctgatgaccccagctatcttctatgtgctgatcgtcagcctgatcaacgcattccagctcttcccgcaaatcatgatcatgaccgacggcggccccaatggcgccacacaggtcatggtggagcgcatctacaagtatggcttccgctactaccgcatgggctatgcggcggccttctcctggatcctgttcgccatcattatggtgtgcaccgccatccagatgaagggccaagagaggtgggtcaactatgacagctaaacgcagactgggcaccacaggctattatgtggtctccatcctcattgccgtggtggccatgatccccttcctgtggatgatctccacctctctcaagagccggggtgctctcatgtccatccccattgagtggattccggcagagccctcgttggatgcctatggtgaggtattttcccgttttccattcctaaagacgattggaaacagcctctttatttccgtgtcctacactgtcatcaccctgatttctgcctcgatggcagccttcgcttttgccaaaatccgtttccgctgcgcgaacctactgctcaagctctacctggccaccatgatgatccccacacaggtgaccatgatcccgctctttgtgatcatgaatcggttgggcctgatcgacagctatgccagtgtgatcctcccctccctcttccgcccctttgcagttttcatgctggttcagcagatgcgtaccgtaccggcggactatttggacgccgcacgggtggatggggcaaacattttccaggtctattcccgggtggccctgccgctgtgcgcgccgaccctggcgacgctggcagtgaccacttttatggagtcctggaacgactacctctggcctctgctgatgttgaccgaccgggccaagatgaccctgcccatcgccctgtccacactgaacggccagtacaataccgagtacaatgtgctgatggcaggcagcctgatctccatgatcccaattatcatcatctacctgtttgcgcagaagcacttcaaaaacggcctgatggcaggcggcatcaaggggtgaaccgatgagagagattttgtgttccggccaggcgcggtccctggaatttccctatccgggcggtatggccgccctctgctggagccctgcgggggagcggggggagttgacggtctccctgcactatgacggggcctatggcatgggagagaagtacaatgccgtgaatcagaagggacatacggcggtcaatgaggtggaggagaagttctgctttcagggagagaaaacctactgcccggcgcctttcttctggacaaatacgggcttcgggctatatgcggccacggatgagcgcaccagcttccgatttggtgagaaagcggtttgcgcggagctgcctgtggattgccgcgtcgtgctgttttcggggatgcccggagagatcattcgggattacatggatctgttcggcccggcaaagctgccgcccaaatgggcctttgggccgtggatctccgccaaccactgggacagccaggagaaagtggagcgggcggtggcgcaggcggaggaacacggctttccagtctgcgccttggtggccgaggcgtggagcgatgaggctaccttttatgttttccggggcgcaaggtatgttcctaagccgaatggcggcgcattccggctggaggacttcgatttttccgattccccctggccggatcccgctggtatggtacagcggcttcacgagaaggggatccgtttcctgctgtggcagatccccgtctacaaaaagcaggggccggatgagccgctcaatgcgcaaaatgagctggaccaggcggatgccgtcgcccggggcctctgcgtccacaacgcagatgggagtccctataccatcccggagggatactggttcgccggctccatgatccccgacttcaccaaccctgccgcagaggagacctggttttccaagcgaaactatctcacagagatggggatagacgggttcaagaccgatggaggcgagttcatctaccgggaagatgtgcgctttgcggatggaagctccggccgggccggaaagaaccgctatgcccaggagtatacggcggcttacaccaaacatctgggttcggctcaggcgctgttcagccgggcgggctacgctggtcagcataccacgcctatccattgggctggagatcagcagtcccagaacagcgagttggccagcgccctgcgggcggggttgtccgctgccctgaccggcatcccgttctggggcttcgacatcgggggctttgcagggccgctccccacattggacttgtaccgcagggctacacagatggcctgctttgtaccggtgatgcaatggcactccgagccggatggagggcagttccgcgagttgatgcccgggggagaggggaacaatgagcggagcccttggaatctggcggcggcttacggtaagccggagttcgtggacgagatgcggttctggcataatctgcggatggaacttctgccctacctgtacagtgtcgcgctggattgtgcggaagcttccaagcctatgatgcggccgctggtctatcagtggccggaagatccgctggtatgggactgcgaagatgaattccttctgggtgacagtctgctggtggcgccgctgctggaagaaaacgccgagaagcgcgcggtctatctcccggaaggacagtggatcggcctgttcgaccgccgcgcggcggccggagggcagaccatcgtagcgggcggagaccggaggctgccggtctttctgcgggcgggctatggtctggcgctccgttctgatgcgaactcggcccccggcgctccggcgggagagcgggcagacggaaatgctcctctgcacctgctgttggctggggaatgcgggcgtttccgcttccgggacgagctgggcaccgacttggatatcacctggtctgatggagccgtccacatagagggcgactaccgattcctgctgacttgggaagtgctccccgtggaggaatgctgatatggggatgtgcggtatcatttttgatttggacggcgtgctgtgctataccgaccactaccattatcttgcgtggaaggcggtggccgataggctgagcctgccttttgacgaacaggtaaacaaccgcctccgaggtgtcagccggatggagagcctggagattattctgagccttggcagtaagacctactcccaggaggagaaggagcagatggcagccgagaaaaaccggctctatcgcagctatctggaacgtatggggccagaggcactggcccctggggcagtcgatgtgctccgcactttgcgggagaacggctggaaaacaggcatcggctcctccagcaaaaacgcccccctcattttggaacgaaccggactggacggattctttgacgcggtggcagatggcagtcagattaccaagtcgaaacctgatccggaagtgttccggctggcggcgcggaaattacgcctttcccctgatgagtgtgctgtggtggaggacgcctccgccggaatcctggccgcaaatgcaggcggcttttttcccatcggcctgggggacgccgcccaggcccccggctgccgcgccgtcctaaacgctctgtatgaattgcccgaactctgccggcgcttatacagccgcgccccaaaattcaagccttccgaccctactccattttcatagggcggaggagcggtcaaaaaggaggaacgcccgccgggccggcggtgcggcagtgtggagacctgccgtaacgtccgcagagtgacgctctctgcgggcaagagggtatttgcggaggcattgcccttacggccctgaacatggcaactgtatccctgaagaatgtgaagaagatctatgacaacaaggtgaccgcggttcacgacttcaacctggagattgcggacaaggagttcatcgtcctggtcggcccctccggctgcggcaagtccaccacgctgcggatgatcgccggcctggaggatatctccgagggcgatctggtcatcggcggcaagcggatgaacgatgtggagccgaaggatcgggacatcgccatggtcttccagagctacgccctgtacccccacatgaccgtatatgagaacatggccttcgccctgaagctgcgcaaggtacccaaggaggagatcgacaagaaggtgcgggaggcggccgagattctggacatcacccagtacctggaccgcaagcccaaggcgctgtccggcggccagcgccagcgcgtggccatcggccgcgccatcgtccgtgatccccaggtgttcctgatggacgagccgctgtccaacctggacgccaagctgcgcaaccagatgcgcgcggagatcatcaagctgcgccagcgcatcaacaccaccttcatctacgtcacccacgaccagaccgaggccatgaccctgggcgaccgcatcgtcatcatgaaggacggcttcatccagcagatcggcaccccccaggaggtgttcgaccagcccgccaacctgttcgtggccggcttcatcggctcgccccagatgaacttcttcgacggcgagctggagaagaaggacggcaagtaccagctcaaggtgggcgaggccaccgtggtgctgggagacaaggcccaggagctgctgaccgggaagggcgtgggcgagcgcaaggtgactgtgggcatccgtcccgagcacatcgcctttgccgctgcccctggcagcgataccgtgtccagcaaggtggacgtgtccgagatgatgggcagcgaggtgtacctgcacgtcaacgccgtggggcgcgacgtggtgctgcgcatccccaccaccgacctgcccgccgagcaccgggccggcatcccctacggcacggagatcaactttgccttccgccccgacctcatccacctctttgaccctgagaccgagaagaacctgatgtactaagggcattgctctccgccgatttgtagaaccgcccggacaagccgcacccagaggaggtgagcgatggaactctgaagcagaccgttttaccgaaagaaaaagggaggattgcgcattgaaaaagatttttcgagtctgtatagcattgcttctatgtttttctttggttaccccggcattcgccctggacggaatatggcacaatccctatggcattgatgatctctatgaccatgaacccaccgagatataccctctgactcccatcgccggtgagatgatttatatcaagagcacaacatggccggtggaggcaggacagtcagtgtggctcacctatacgaagaatggggagccccaaccggatatcggcgcagaatggaagtacaacagcggaaacaacagctattgggaggctgctattggtccttttgaaaagggtgatgttattgagtataccgtctttgcagacaaagatgggcagaacacgcagtctattggcccgttctctttccacgtagtggaatgggaaagggcgcagtctgtagaactcggttcacaggaagatggccttgttgttctgaatgtaacgtctgaccaaggggattctacgcctaagctggggctcagcttcccatctgctgatgtcctgcgcttccagttttccccgctgggagatgtggccttcgaggcaggggctgctgactacagtattgaagaggacagcaatagcatcattatttccaccagcgcacttgaagtgacggttacaaagtcgccttatggcgtggaagtgcgggatttggataccggcaaacttctgacacagaacggaggcactggcagcgagctatcctggctgacggatggcgccggcttcgtgaaaaatttccgtggcaggtatgaatcgccttccagtgaaaagttttacggatttggggagcgttataacggaattgaaaagcgtggagaaacggtggatatttacgtttataaccagtaccagaatcagggcgaaagaagctatctggccgtaccgtttttctattccagcaagggatacggcttgtatcttgattccacctattacgctcagttcgatatggcagacagcgatccgaaccagtatacctttaccgtgaatacctctggtgatgatcctgtgctggattattatattatcagcggaacgccggaagaggtgattggcggctattccgagcttagtgggaagccccaggatatgcccaaatgggcatttgggctttggatgtccgccaatgagtgggatagacagtccgaggtgctttcggccgtagaaaacgcagaggcctatgacattccggcctctgtagtggtcttggaacagtggagcgacgaaaacaccttctatatcttcaatgacagcacctatacggcgaagccgggcggagaggcgttttccggcagtgactttacctacagcgagaaatggcctgatcccgcctctatggtggataccatccatgacaatgggatgaaggtgctgctgtggcagattcctgtgctcaaatacaccgattatgcctgggagcagaaggacaatgacgaggcatacatgattgagcaaggctacgccgtcggagacggcgagggaggccaataccgtatcccatcctccgggtggttcggcaatagcctgcttttggacttcaccaatccggacgcggtggactggtggatgtctaagcgtgcttacctgttcgatgatattggaattgatggcttcaagaccgatggcggtgaaatggtctggggccgcaatacctccttctacgacggaagcgatggcctggaaatgcgcaatgagtatccgaatgcctatatcgaagcgtattacgactttacagaggaaaacaccggtaccggtatgaccttcagccgcgccggcaccgcaggcgtccagtccaccggcgtattctgggctggcgatcagtcttccacctttgatgcgcttcaagattcgatcagcgccggtttaagtgctggtatctctggcatcccattctggggatgggatctggctggattcaccggcgatttcccaaccgcagagctgtacaagcgcagcacccaggcagcggcgtttgtgcctatcatgcagttccatagcgagaaggcaaatcccagccccagcgaggaacgcagtccctggaatgtgcaggagcgcaccggagatgataccatcatccccacgttccggtattatgtgaataccagaatgaacattctgccctatatttatagtgaggcacagcagtgcacagaggatggcaccccgctgatgcgtgccatgatgatcgacttcccggaggatccggaagcctacgacttagaagagcagtatatgtttggccggtcgcttcttgtggcacctgtcctcgaagaggggcagaccgtaaaggaaatctatctgcccgaaggcgagtggattgatttcttccacaacgctctcaccgccggaggcggcacaaagaattactactgcgatgtagattctatccctgtctacgttcgcaatgggagcattattcccatgaatctcaacgaagattatgaattgggcggctccatcggcaacgatgtggacaactacacgaatctgactttccgggtatacccgaagggtgatagtagctatacacttgtccacagcgaccggtccacgatgaccgtaagcgccagcgaggactttaagaacagctcggtatccgtctctatccccgctgccgctattccggtcactacgcaagtgttcggcacggagccgactggtgtcacggtcaacgggcaggccatccagcgtgctgctactttggatgaattccaagctgctcagacggcctattactacagcagcagcgagaagctggtctatatcaagaccgccgccggtgacgcttctgaaattgagattgaggggatctatcaggctccctatgaagcggaacatgcggagcaggccaatgtagccgtaaacacagatcacgaaggctattatggtgaggggtttgtggaccagtttgcctctgaaggctgtgcggtcacatttactgtgaactctgacggcgacaccgctctgctggacgtccgctactctgcagggactgaggcggcccagcggactctgcttgtaaacggagagtccatagtgctcgatctgccgaaaacgcaagactgggatagctggaacacagtatctgttcctgtcgaattggtgtcggggcaaaatacaattacaatttcctatcaggcggggaacttcgccggaatcaacctagactgtatctcacttcggaatcagtgacgacttgaaccaacacagggaggtgcatggggcttccctatgcacctccctgttgtcttattaaggaggaactgtatgcgaacgataagaaaacggctgcttgccctcttgctgacggtcgctatgctgggtaccctgtttgcgggtcttccgattgcttcggccgcatcggaggcgctcggaaatgtgacggacgccgcagtagatggaaatacgcttttactgacgattgacagcggcgggagcgcgtcagatctgcttacattggaagtatgccaagacaatatccttcgggtagattaccagccagagtctgtggaacccagcccagacaccccgattattgaccctgagcttacttgggataccactacggcaacggaaatcgacattaccggcgatcccattgtgatccagacagacggcatgcgcattgaaatcagccgtacgccatgccgcatgacggtgatgcaggccgacggaactacgctgttctgggaaccagagagcggaggcatctaccacgacggggtgcgcttcgtacgcgctgaatccagcaatatgtatggtattcatggatttgactgcttcagcgataatgggaaccttctgcggaacgacaacagctctacggccgcagcagggcagcagggaaattccggcggcccgtttatgtggtcaactgccggatatggtattctggtggactctgacggcggctatccctatacaaactccaccgaccgcaagatggaattctattatgggggaacgccggcggagggccgccgctacgagaaagaagacgtagaatatttcatcatgctgggagagccgaaggagattatggccggcttctccaaaatcacagggacatctcccatgatgccaaaatggtctttgggattctccaactttgagtgggatatcgacgaagacgagttctatgaaatggtagagctgtaccgggccaagaatattccgattgatggctatgcttttgattacgactggaaacgttatggcgatgataattacggggaatttacctggaatacggataacttcccttctgcggcctccacgcagctaaaggaggatatggaatccaagggtattaagatgattggcatcaccaaaccccgcgtagtgaccaagctctctgacggaacaccgactgaacaaggtgtggacgcagaggccggagactacttctatccgggccactatgaatacacagactacttcctgcctgtgactgtgcgcagcatcgatccctacaaagcagcagaacggaactggtggtggctccactctcaggatgctttcgatcggggcatcgttggatggtggaacgatgagacggacaaggtctcctcaaatggtgcagattactggttcggcaactttaccacagcctttatttctcaggccatgtatgaaggacagcgggaatataccgatgacagcgtccgtgtctggcagactgcacgcaattactatcccggtacgcagaggtacgccaccagcatctggtccggtgacgtggcaacccaattctacaagggagaacgggtatcttgggcggctggactaaatgagcaaaaggctgcgatgctgtccaccatcaataacgggcagcccaagtggggcagcgatggcggcggcttcaaccagaactccgggaacattgaaaaccccagtccggagctctacaccagatggctgcaattcgcttctatgagtccggttttccgcgtccatggaacaaatcatcaacagcgccagccttggtactttggtacaacggcggaagaagtgaccaggtccgccattcagcagcggtattccctgatcccgtacatgtattcttatgagcgggaggcctatgactccggtttggggctggtgtatcccctgctgttcgactatcccgacgacgaaaacgtggctgactactccgatgcctggatgtttggggagtggctgctcgttgcccctatcacagaacgtggtcaatccgtgaagtggatctatctgccggaaggcacctggattgactataatcgcggcactgtttatgagggcggccagtatattccctacagcctcaatagcgagtcttggaccgacattccgatgtttatcaaagaaggcgccattattccgaagcaggacgtgcaggactatgtcggacaggaaactgtggatcatgtgacggtagacatcttcccgagcggccgggagaccagcttccgctattatgatgacgatggagaaacctatgactatgaggacggcgtgtatttcacacaggaaatctccgcgcaaggtaccggaaataccgaagtgaagatcggtgcagtcgatggaagccacaactccggattggactactattacttggccgtccatggccaggcggctaccgaggttaccagcaacgggagcctgccctattatgatgactataatgcgctgttagcggcgcctggagaaggctggacagtgggcaaggatgtgtatggggatgtaacctatatcaaggcctatgccgcttctgacagcaacagcacttacacgctcgaaggcagcagccccgtcgatgcggatggccagacctacgaagcggagtatgcttccctttttggcgcttctacagacacgcaggcctctgtgaaccagaatcactccggctactccggagcggggtttgtcgacaagctggaagccgctggcgccggcgttaccttctatgctaaggtggccaatgcgggtgattatgacgtcaccttccggtacgccaatggcgatgcagcagagcggtctctgtcggtctatgtcaatggggcttatatcggcaaaaccataatgccctccaccggacactgggacacctgggcggattgcctgatgcagcttccgctggcggcaggaaacaacatcatcactcttaagcatgaggatgccagcggagacaccggctatgtcaacttggattcttgcaccgtgccgttctatccggaagtgatcaccgcagaggccgagaacgccgcgctctacggcaccgccggcacaaatcaggatcactggaattacagcggaagcggctttgttgacgggatgacttccgccggtgcgggcgctgagtttgagattacggttccgaaggacggaagctatgaggcctctatccgttactgcaatggcacccaggccacgaaagacctgaatctgtatgtcaacggttcctatatagagacaatctcttttggaagtatcggcggaaactggaacgagtggcaggagcttacccagacgctggagcttgatgaaggccggaatgtcgttgcgctacgttacgacagcagcaactccggcaatgtaaatctggacaagctgtcagtgaagacagagcccgacgccacaatttcggtccccttggtagacaatggcggattcgagcgggacacctcacagagcagcgcctggacagagtggcaccctgatggtcaggcagtggcctatggagtagactccggatccggtaccaacccgccggaatccccatacgccggcgacaagcgcgcctatttctacagcggcagtgcataccagcagagtatccaccagggaatcaacctcccgaatggaacctataccgttcaagcctggataaaggtttccaatacggctccagacattggacgcatggaggtcactggttatggaggcgacagcatctatgttgatatgccttatgcaggaacagggtggaggctggttgagacggatatcaccgttacaacaggctatctggacattgggttctactgctccagcctaggcggtacaactgtgcatatagacaatgttaagattttgaataaatagcggaatttaatgagttaactaaaagattattattaaaatatacttaaatcgaagaacatacccgaagagggacgggcctccgcaaaagcggaggcccgtccctctctatcggattcgcatgtcaggagggggaaagctagacaaatgcaagagagagcgctggaacaaaggacaaaatcaacagcaatacacaggagaccaggaaaaatggtacgacccatttgagcatgctctccatcttgattttggctacggccgcacccacgaagaggttgcagccataaggaggcgtacacagaccaacagctaggtttaccgacatgacaacaccgaagtgtatgggattgatgttgaacgcctggatggtaggcagcagcataggcgcgatgatgatgatggcgggcacggtatccagaaaacagcccacgatcagcagaaacacattgatgaccagcaacaacactacagggctgtcggacagattggccatgaagttggtgatcatctgggggacctgttcgaaggtcatgaaggtggagaacactgtggaggtgcccagcaggaaggaagtaacgccgttgaggacagcggcggacacaaaagttttatacaggtccttccaagtcatgtcgtggtacacgaacagggacacgatgatggagtacacaaccgagacagcggcggcctcagtgggagtgaagaagccagagtagatgccacctaggataataaagggagagagcagagcccagaacccgtccttggtggccttgcctacccggtgtagccgttctttccagaactggatcatgggaatcctttctccgccgggcccaagctcgggtttgtggacctcggtgccagtgcgcttgcagatgatgatgtttaccatcaaaaataccaggccgatcataacgccggggatgataccggccttgaagagatcaggcacggaggttttggttgaagctccgtagagcacaaaggatagggagggcggaatgatgggccccacgataccgccgaagcagaccagagtggcggcgtaggaggaatcataacccttgcgcttcatttcggggatcatcatgccgccgatggcagaggtggtggccatgccggagccggtaagggcgccgaagaacatgcaggccagcatggaaacgcaccccagggcgccggtcacaaaatcgatcagcgcagaggcaaagtccacgatccgccgggcgatgccgccagtggacatgatggtgccggccagcatgaaataggggatggccatgaccgtaaacgagaaaatacctgaatagcagtattgtgcgttgaccaccatgttcagatccgagaagaaaaacatggagatcatggttgcgccaccaatggcgaaccccacaggcacaccgatcgccagcaggacaaacagcaaaatcaacaggacaatgactgcatccatgcttaatcccccccttcccgggccttggtgtcagcgggtaatttgccattgatgagggtgagggcagagcgcttgatgctcaccagtgtgcggagaatcatcagtccgcagcccagcaccaccgccaagtagccccaggaggtgctgatcttgatgccagcatagggcacattgccctgagcgaccaccagttccacgccatagtagaagatgacggcgcagatgataatcacgacgatatcggaaatgatgttgacgatctgggccaagcggaaaggcagccgatccgtgagcatagtgattttaatatgctcgccttcccgctgacctagactgatgcccatccaggagatccatacgaacaggaatttccccagctcttccgaccaggacagagaattgccggccttccgcatgatgacctggacgaaaatgatgatgaccatcaaggcaaacatggagacgatgatgacttcttcaatgtgatttaggattgaaaaaatctgtttttttgctgaattcatagacaaattagatgtatcactgaaatacaccttttcccccctctctctacagcatattataggttcccaaccaggccgtaccgatggcttaggcgggcctatatatagtttcctctagggtcagctctggggaacggtggctagccagcggtccatcagatcgtcgccgatctgcgcacgcagatcgtcatacacaggctgcacggcctccttgaaagcagcgacctcttcatcggtgagctcctccacagtggcgccttcctccttgaagcgctcaatatactccatttcgttggcgcgctcctcctcgcgctgctgctcgcaggccaaggccacgccctcctcgatcagcgcccggtcctcaggatccagggactcgatccattccagggagcacacaatggggaagggggagcttgcgtggttggtgatggtgatgtagggcgcgatctcatggatgttgaagtcattgaacacacccaaggagtggtcaagtgcctcgatggtgcctgtggagagggaggtcagcacttcgttccaggacatgggggtaggactgccgcccatagcgtcccaggtcttgatgtccagatcgttctgcgccacgcggatcttctggccatgcagatcctcggaattgtggtaggtactggtgcggctgatcacctgacgcattccattatagaacatgccaacgcagtaatagccggagggtgccaaggtctcgttaaacagctccagaccgccattttcaaaggtgccctgcacccagtcctcataggtggggtacaggtagggtaggtctaccgcgctagtcgcgggtccggacacggaacttaccacggaggataggtcgaactccatggtgagagtgcccagctttacaccggccaccatgtcgggggagtcgcccaactggccattggggtaaacctccactttgaaacggccgggcgcctgatcttccagccactcgcccagccaaacgctccacttgtgagtggaacgcgtatcagagtcggtatggccaattttgatcacaatgggttcctcagaactagtgctgccagtgttgttggcagaggggttatcattaccgccactgctggcactggggcggctacagccggagaaaagagccaggctcatggctgccgcgagagtaagcgctaaaatttttttccgtttcatagttctctccttcctgttcattgcagatggttctatctttcagcggataggccgcagacattcgccgtttaggccagggacaggatcctgcgggcctcgccggggttggcgatctcgcggcccagctccttggagaggcgtaccaccttggccaccagctcaccgttggaggcggccttgtggcccttgcccaggtagatgttgtcctcaaagccaacgcggacattgccgcccattacgatgccggcggcggccatgtcccaggcgctgcggccgatgccggtgacggtccaggtggagccggaggggatttgcttgactaagtaattcaggttgcccaccgtggcgggggtgcagccggacacccccagcacgaagttgaactgcatgggggcgccgggcaccaggcctttcttggccatgttcaggatggtgtccagatggccgatctcaaagcactcatactcgggcttgatgcggttctcgatcatccgctgaccaaaggcccgcatggtaggcatatcgttgacgaagatgtcgtcgccgaagttgcaggtgccgcagtccagggtggccatctcggggaagagctcggtgggctgaaggcgctcctccggggtcatgccggtggcgccgccagtggaggggatcaggatgacgccaggacaggccgccttgatggcttccagcactacgcggaaccgttcccggtcctgggtgggggtgccgtcgtcccaacggacatgcacatgaatgaccgccgcgcccgcatcatacgcgctcttggcctctcgtaccatctcctccacggtgtaggggatagcggggctgttttccttggtgacctccgcgccgcatatggctgcggtaatgatgagtttttccatcattctcacttcctttcttaaacaaattttatttgcagtagcgttttgtgaagtaatctcgtagcttctcctcccttcgcacagcgtcaaaggcaatttctgcatggccggggtaatatccatttccgataagcatgggcacatatttcttgatgccctcggcccccagagacgctttggcaaaatcagtactcatgctgaaaaagtagaccattcccgtatctttagttacaagcaccgtggccaattccgtgttaggtacactcacggtgttgaccgtgaagtccgccagttggtcacccaatgcattctggtaaatatccagggcctccagaggcttcttggcatcggcttccagcacaacgtccgcaatgcccaggctacgcacaatctcacactgccggggggaatattccatgcagatcaccttgccagtgggagctacccgttttttagcctccgccaggcagagaagcccggccttgccggcacccaccactaccacggtatctcccgccttgacgtggactgcaacttgggccggggcaccggccacatccatcaacgccaggctaagctggtcgccaaggtcctccggaagcttggtgtaaatgccgctctcgaacagtatggcgctggctttacaaaagacctgctcggtgtccacgtcaatggacgtgatctcattaatttttagaggagtgagtgacagggacactaaagtggcgatcttatcgcccacctgggcgtctgtagagccagccagatcggcgccaatctccttgatgcgaccgatcagaataccgccagattttgttaccgggtcttggaactttccgcgctcgtccacgatcttctggatctcctgggcgatccggttcacatcgccgccacactcttgcttgatgcggccaaaggctgtggccgttggctggagcgcgatgacgtcgatcagaatctcattggaacaaatagtgggggagttgtccacccgttctgctgcctgcggaagcaatcctttgggggaaatgacacgatggcttccgtatggatctcctcgcatggtagagtctcctttctgtagcgaaatactatatttttgaactgcaagctgcgtgccaactcattttttgatatttttactagttttatctttagtgaaacgggaattcgaagtccattaacagaagagcgaaccataaattgatcgaacgatcaatttatggttcgcttgtgattcaaaaaaggttcacttgtcttccgattgaagaccgtacagatttaattttcggactacagaggattgactaatccccagcatgttggcaatctttcgagtggacttgtaccgttgctggtataactggaggatttcccgttcccgctggctcaacatttccttcagagaaccgccggtggtctgcttgtgaaaatccggagatggaacggctgctgctacagaaggcggctccacgctgtccatggagaggacttggagcacgtcccgcgcctcaatgatccggttatttgtcataatcatcagccgctggatcagattttgcaactcgcggatatttccgcgaaaggactggttctccagaaattccagtgcttttgcgcctagcgacttttgaagcccgaattccaggttgtatcgctctacaaagtatttggctaaggggatgatgtctgcccggcgcatgcgcagaggcaaaacggtgatgggatagacgttcagccggtagtaaaggtcctctcggaattccccggcctgcaccatgcgagctagatttcggttggtggcagcgatgatccgtacatccaccttgatgggagttagcccaccgacacgaacaatttctttttcttggatcacgcgcagcaacttggcctggaaagtaaggggaagctcgcccacctcgtccaagaatagagtgccgttctgtgcagcttcccagaggccgattttccccttgatgtttgctccggtaaaggaacccttttcgtagccaaacagttccgactccagcagatgctccggaatcgcggcacagttgattttgaccattgggaagctttttcgctcgctgttctgatgaataattctggcaataatttcctttccaacaccggattcgccatagatcatgacgttggaggtatagcgggcaactttaagcgcctggcgcagagtggccttggcctccaagctatggaagatatatccgctcgcacagtcctcgtccgcttcactctttgcgtgcggtgtttcgtccgagttcgggatagagatagtctccggcacaccgcatatcccgcgctggatgtctgtctgcatttgcgggaacctgcgcattagtcccaaagtgtagtctgcgtgtccctccaaaaagcctgtgtaagggatgacctgaatctctttgccgatactttctgcggtcagcgccacgaatttatagtcgcagcatatggtggcaaagtatatggtcccatggtttttgactgccaataggcttgcagcctcagtgtctgctgtgttgatacagttgatgactacatcaaagcgctgaatgatctccgcgtgtggagtgccgcataaagcgctcaggttggtggcgtccagttccaacacctcgtcgaacacgctgcatggttccatttgaatacggctttcctgatctcgcacgatacctacaagccgtccgctggagcccatcttatccttagcggcatagccacacatcagaccgatgcggccgctggcaccgagtatcagtacatcctgcccaggttgcacgatctgataggagcgagtaggggcgccagcctcatccatagctgcaatcacggctcgcaggggcaagtccggcggttttttgacgactggagagttggcatataggatggcctgaccctctacctccagttgggcgctttcgcagtcaatgcggaggatctgcgtaatgtgcagaggggttaccgtgagggaggacagagatatgatctcgtcctttggccggatatggtaaatatttgggtagctgggacctaactccaccacggtgccatataacattcctccactgttggttaccggattgtgaagttttccccgctcgcggacaatttctaaaacgcgttgacacagcaaggctctgtcctcgcctgtttcgtccagaatttcattgaagctggccaaattgatattgatgattttgacgtcgatgagaacctcgtccgaccgaagcgtcatcgtattatctattttccacgcctgttgggccagggcgtgccgcggctctatagatcgttctagcccaaagctatccattatagatgccctcttctgtcgcttaatttgatagaaagcggacgggccccattggggacccgtccggcaactgtttatttccgcttgcagttctttgggaccacacaggtgccgctggctcggcagaccagaaccggctcatccagaacgtcggccgctgaagcgcttacgtccggcctagctgtaatgaccttgtacgcggtaaaggtcatcttgcgggacgtatttccgatataagtgatctcgcccttcgcttcgatgtagtctccggcgtaaacaggagccagaaactctatattgtcgtatgcgcaaaacaacccctcatcgccgtcgcagcggatcagcagttcggtagccacatcgccaaagaggtgcagcatatgtgcgccatctaccagatttccaccatagtgtgcatctttggcagacattcttacgcgcagttcagaaacaaacttttccataaacttagtctcctttcttttgagggacaacgccccctctggaaatagtgtatagcaattttaataccaactgttactcgatgtgtgctctgcttggtgttggaagtatgtcacaggggattatagcacaaaaaacaatatatttttagatgcataatacggctgatataatctaacggattctgagatttttacagaaaataaaggcctggatgaattactgcagagttggaaatattcaccgcaaagacattccgttatgagactgcaaagcccagagactatgttgtgggagccatggtggacgaagcgataaattgttggcctttctctcgagtgcatgcgcataaatgggggggccatagtcatcgggaagacccgaaaaccagtcggtggcgtgcgagctacgttactttcgagcgatgccgcgatatgcccggcatctggaaataccgcgggcattgctttcggggtgagacggtggagcgtggccaggatccggtctgctgctgaaagatttgtactttgaaatatggggggccagagttttgccggccgcctgttttatggagtaaaggtaacgtgaagcggctgccggaactggacaggctggtgcagtccgcttacggggataaggtcatgggacgcgtcccggaaaacctgtgtgtccagctcttgaatggctatgaagtagagcgagccgcaaagcaggagcggcgtaaggtactttgcgaactgctgtctgccaggcgggaaaaagaacagtccgtagacgagtggctgaacatgatgcaggattatgctcagctggaagaagtggatcgccccacactggttcggctcattcagacgcaaggtaaaatcagcgttcaaggccaaatttgccaaaggacaaaggattttcgcctatgtgcccattggctgccgcaaggacccggaggaaaaatgccatttgctgattgctgaggatacccgctggataattaaaaaaatttatgcccttgcggtgcgtggggtgggagccgctaaaacctccaaggtactgacgcaagagaagggatccacccccggctggctgaactatcagcgcaaagggacatttgcaaacatctacgccaacgccccggagggaaaagcctacgcctggaccatagcccaggtcaaaagcattttggaggatgaaacctacatcgaaaattcggtccattaccgggaaacaaatatctccaacaaaaataagaagcgtatccgcaaggaccccagcgagtgggtacgtgtcgaggggactcatgaggcgatcatttcgaaagatgtttttgaccgtgtgcaggaacagatcgccacacgccgccgttctatgaaggaccagacaacacaaattttctccaggcttctcaaatgcgccggttgtggctggtctatgcgtttcaggacaaaacgccagatcaagaaaccatacaggcattacgattgcagccgctatggacaactcggcaatcagtgttccgcacattatgtccgctatgatgttctttagctctatgttctctcacgtttgcagttctggattaaggcggtccatcagaatgagaaagccatagccgcccgccttttgaagccctccaacagtggacaggaggcaaagcacagacgggcggcggcggagaaaaagcgggcggaaaaacgtcttgccgagctggacagcctgatagcccggatatatgaggacaggaccgcggaggtcatgaccgcccggaacttctctatgctctcccaaaagtaccagcaggagcagaaggcgctggagactaagatcctggccttgaatacacagcttgaagccgcacgggaacagacggaaacattgaaaaatggcttgttttggtaaagcaatatgccgacctgtctgagctgaccgcagaagtatgattaccttgattgaaaaatccttatccatgaggtgataaaggacagcgagggaaaacgggtacagaaaatcgagattttctatcgcttcattggcaacatcgaccaagccgttgacaccatctttttaactgcgtgaaacggaccagattttaccggacagtgaaaaaataattcggctgagtgagatcttcggagtaacaacggattatttgttcaaaggcaaagagtcagaccctatggacatctatgtccagcatacttcaaaaggcgggggcggatatgtctgcgaaggtgacggagcgcttggaagaggtacgccgcatgagcaccgccagcggcccttctgctggcggccgccgcggttattgctggacgcatttgctgctcaagtgttgaccggcggacggcctgcactaaggcaaacagcaggcggagcaaagaggcgcggggcaatgccccgcgcctcttttatcgggatttgggtttgggtttaaagatcagggccaccagccagccgaagaagatggcggcggagatgccgcccgccgcggcggtgacgccgccggtgagggcgcccagtatgcccatctcgtccacggccttggcggctcccttggccagcagatagccaaagccggtcagggggacggtagcccccgctccgccgaactccaccacatacttgtagagccccagcccgcccagcaccacgccggacaccacatagagcaccagaatacgggccggagtgagcttggtcttgtcaatgagcagctgcccgatcaggcagagcaccccgccgcagaggaaggcgcgggcgtattcccaaaagacttccatgattttccctcactgttccgttgagatggccaccgcgtggcagatggacgggatgctctccccctggagcgtggaggtgggggagagcagggcgccggtgccgcagaagagcaggcgcctccagcggccctgcttcataccgttgagcagaaagccggtgagcaccgcggcggagcagccgcagcccgagccgccgcagtggacgtcctgggtctgggcgtcgtagatgagcacgccgcagtcctccagatttttgaattcaatgccgtcccggtggaagagatccagcagaatctccttgcccaggctgcccagatcgccggtgacaatcagatcatagtccgagggcctgcggcctgtgtcccgaaaatgggcctgaatggtatcataggcggcgggggccatagcggctcccatattgttagcatcttggatgcccttgtccacaatcttgcctgtggtcacatgggtgatataggggcccggcccctcccgggagaggatgacgcagcccgcccccgtcaccgtccactgggcggtgggggtgcgctggccgccgtactccaggggcgtgcggtactgccgttcggcggagcagaaatgggaggaggtcatggcggcggcgtgggtggcgaaaccgccgtccagcagcagggcggccagagacaggctctccgccatagtggaacaggcgccatacagcccgaagaaggggacgtcctgcccccggacggcgaagccggagccaatgcactggttgagcaggtcgccggccagaatatagtccagggcggaggcgctcagccccgccttgtccagcgcggaggagagggccagcttctgcatggcggtctccgccttctcccaggtcttttccccaaaggaatcgtcctgattgatctggtcgaagctgtcggccagcgggccctccccttcttttttccccaccacattggcgtggcccgcgacggagggcgggtgggcaagggcgaccgtctgccggcccagcttttttgtggtcatagcgccaaccttctttccttcagataatgctattttgaacgaaaagccgggaaaatatgaggctggattttgtggcgggacatgctggtcaaaaagagggctttgcggtataataaacagcagaaaccggattcattgaaatggaggcatatcatggtcgaggaagccaagcgtactctggcctatctctgtcccgcctgccgccagagcgtggcggtggagcgcagcgtattccagctggcggcgtccgccaacgaactgccctgcccctgcggcaaatcctccctccgggtggagctgatgggcgaccgggtgaagctcaccgtcccctgcctgttctgcggcaaggatcacaccgtcacctgctcctcccacgcctttctccacgagaaggtactggccttctcctgcgccgcctcggggctggactgctgctacgtgggggaggaggggccggtgtttgccgccctccagcgcctggaggaagcggtggacaagctggaggccgcttcgggggagaagggggccttcctggacgagctggtgatgcaggaggtgctctccgagctcaaggagatcgcccagcgggacggcatctcctgcacctgcggctcccaccgctggaagctccaggtcaatttcagctccatcgacctgttctgcgccgactgcggcggggccatgcgcattccggcggccaccgccagcgacatcgacgacatctgctgtaaaaacaagctggtcatccacggccaggactgaggaggcggaagcatggtggtatacgagtgcgagtacatggtggactccagggacatcgacccctggtaccactgccgcccctccgggctgatggggatgctccaggaggccgccacccaggcggcctgtgcccttcacgtctcccgggacgagatgctggagcggtacaacagcttctggatgctggcccggctgtggtaccggctggatgtccctctgagctggggggacacggtacacatccgcacctggcaccggggcgggaggggagcctccacctaccgggacttcgacctgtttgtgaatggacagccggtgggggaggcggtgtccacctgggtgctggccgacgccgctacccacaagctggcccgcatgggcaggatcacggagttccagggcaccgacggcggccctctctgcaaggagcgcaccctgtcccgggtccgcctgcccgaaactatggagcacgcggacagccgcgccatgcactacagtgataccgacgtcaacggccacgtcaacaatgtccgttatgtggacttcctctgcgacgccctccacatggagcgcctgggccccagccgcttcgtctcctccctccaggtgggctacctggccgagtgcgtggcgggggagaccatcgagctctacaccggccaggccggcggcctgtggtacgtccacggggcggatcaggcgggcaagagccggtttgacggcgcggtggagctggcggagctcaccccttgacagcggcggagccatcgagtaaaatagaaaaaatttaacctctgagagagcaaaaagataaaaggagatgcaccatggtcaacactgacgagcgccagaagttcacccggcagggcctcaccttcgacgacgtgctgctcatccccgccgagagcgacgtcctgcccgcagacatcgatctgcatacccagctcacccgcaggatcaggcttaacatccccctgatgagcgccgccatggataccgtcaccgagtaccgcatggccatcgccatcgcccgtgagggcggcatcggcatcattcataaaaatatgtccatcggcgcccaggccgagcaggtggacatggtcaagcgcagcgagaacggcgtcatcaccaaccccttctggctggcccccggccatacgctggcggaggccgacgagctcatggccaagtaccgcatctccggcgtgcccatctgcaaggacggcaagctcatcggtattattaccaaccgggacatgaagtttgagaccgacatgagccagttggtggacaacgtgatgaccagggacaacctggtcaccgccagggagggcgtcacgctggaggaggccaaggagatcctgcgccggcacaagatcgagaagctacccatcgtggacgatgagaaccacctcaagggcctcatcaccatcaaggacatcgagaaggccaccgtataccccaactccgcccgcgacgagaagggccgcctgctggtgggcgccgccatcggcgccacccccgacgtgctggaccgggtccacgcactggtggaggccggcgtggacgtgctctgcctggactccgcccacggccactccaacaacattctggagtgcgtccgccgcatcaaggccctctaccccgatgtgcagctcatcgccggcaacgtggctaccgcggagggcacccgcgctctcattgaggcgggcgccgactgcgtgaagatcggcatcggccccggctccatctgcaccacccgcgtggtggccggcatcggcgtgccccagatcaccgccgtctatgacgccgcctgcgtggccgccgagtacggcgtgcccatcatcgccgacggcggcgtgaagtactccggcgatctggccaaggccctggccgccggcgccaacgtggtcatgctgggctccctgctggcgggctgcgaggagtcccccggcgacaccgaggtgtaccagggccgccagttcaaggtctaccgcggcatgggctccctgggcgccatggcctgcggctccaaggaccgctacttccagcagaacaacaagaagctggtgcccgagggcgtagagggccgcgtgccctacaagggccccaccggcgacaccatctaccagctcatgggcggcctgcgggccggtatgggctacaccggctgccacaacgtggaggagctgcacaccaaggcccagttcatgcagatcacctccgccggactcaaagagtcccacccccacgacatctatatcaccaaggaagcgcccaactacaccctcaatccccagtaaacggtggagcgcatcacggtacccggcccggacggcggattttccgtacccgccgggctggaacgagaggcagcggagcggctgggccgctatgaggatgcccatgggcgcctgctggcccgccaggaggagctggccgggcggatggaggccctcaaggcccagggaaagcagaagaccgcccagttccgggagctgttcgccgagaagctcaccattcagaataccctgacgctgtgggagacctacggcattcactgaaaaggcccaaaagacggccgccgcccatttgggcggcggccgtctcgcgcgcatggagactaacgggggacatagaccagctcagtcatgccgttgtggacggcggtatggagcagatggggcttccgctcttccgccagcgccccgaacagcgaaacgccgctcccctttgaaaactagttccgcctagccgaccttacggccatgacaagctgtacagccccatacaggccgcagagcaggagaattgtgtcctcataggcgtgaaaaaagatcgatttaatcccagtcagcccccaaagagtcagaagagcaaggagaagcctgttcttgtgccggtaacccgcacagaccgtgatgctcagactgacaatgggacagggcataatatgtgtcaccatttgcggaaaggcgtttcccagaaggagggagacgagggggtaaagcagccagagcagcagaagcagggcctgcgcggcggtgggtttttggagcgtatccgctccgttgtgcctgctctcatacaggaacagaatgccgaagagcagatagagcggaagcgcaaaatacttctggataggttctgatccataacgggcgaaaaaagcgagaccgatccacaagtttgcgattccgagggcaaactttgccgcccatggtgccttttgggtgtaggacagcgcgaacataaccaggagaacgagcaagaggacgatttgcaggccccatgtatccatattataggccccgattaccttccagaagatctgtgcgtccaatttgccgcacctccaaattgcgatattgtttattgtagcatatcggagggacgtgctcaacggggaagtccccgccgtccaagattgcgcggcggggcgggatatgatataatttaatatctgaccagagaatggggggagagacatgctcaagctgctgctgggccgggcggggacgggaaagacccgcgccctgctggaggccatggccgccggggacgggcggccccagattctgatcgtccccgagcagcactcccacagcatggagcgccagctttgcgccatcggaggcagccgggtgtcgctctttgccgaggtgctctccttcacccggctggccaatcgggtgttctccgtgtacggcggtttagccgccccggcgctggacgggggcggccgcctgttgctgctgtgcgccgccctcaagtcggtggccccggagctgcgggtgtaccagcgcccctcccgcaagcccgcctttctctccggcctgctggccacggtggacgagctcaagacctgccgcatcaccccggagcagctctggaccgcgggggaggagagcggcggcggggagggggacaagctgcgggacctctctctcatctacggcgcctacgaggccatgaccgcccgccaggggggcgacccccgggaccggctgacccggctggcggaggcgctcacccgggaggactgggcggcggggaaggacttctacctggacgccttcaccgacttcaccccccaggagcgggcggtgctctccaccctgctggggaaggccaattccgtcaccgtggccctcacctgcgacaagctggaggaggacgaggggggcgcggggattttctcccccgcccgccgcaccgcccgccagctcctccggctggcccaggagcggggcgtttcccgggaaattgaggtgcgttccggcggggccggacccaagacggcggccctggcccacctggagggccagctcttcgccccccggcccgacccctgggcgggcgaggcggaggagctcaccatgctgaaggccaacagcccctactccgaggtggagtggacggcggcggagattttgcgcctggtgcgggaggagggctaccgcttccgggacattgccgtgtgcgcccgcagcctggagggctgcggctccctcgtcgagaccatcttcgcccggtacggggtgcccgtgttcctcagccggatgagcgacattctgcaaaagcccattctggccctcatcacctccgccctggaggccgcgtcggggggctaccgctatgacgacgtgttccgctatctgaaaaccgggctcaccggcctgtcggcggaggacgtggatctgctggagaactacgtgctcaagtggagcctggaggggagcgcctggacgggggcgcgggactgggcgaaccaccccagagggtacggcctgcccttctccgagggggaccgggccctgctggcccggctcaacacgctgcggcgtcaggtagcccagaccctggagggcctgcggaagaacccggacaagacgggccgggggcaggcggccgccctctacgcctttctggaggcggcgggggtgccggagcggctggcccagcgcaccgaggagctgaaccgccgggggcaggccgcgctggcggaggagtatgcccagctctgggagatcctctgcggcggcctggagcagtgcgcccagattctgggggacgcccccatggagctggacgagttctccaagctctttgccctggtgctctcccagtacgacgtgggctccatccccgtgtccctggaccgggtgaatgtgggcgacatgccccgcctggcccaccgggcctgcccggtggtgttcctgctgggggcggacgacggggccatccccgccgccgcgccgtcgccgggcctgctcaacgacgacgaccggagcctgctggcctcctacgggctggagctggccccccggctgtccgacaagctgtaccgggagatgaccatcgtctacgagacctgcgccctgccccagcggcgcttctatttgagctgggcggcggccgggccggacggggaggagcggcggccctccttcctccagtccaagctgaatttcctgttcccccaggcccggcgggtggaggaggggcggctggacggctccttccggctggcggccccccggcccgccctggaactggcggggcggttcccccaggccggggcggccctgcgcgccctgccggaatacgcccccctggtggagcggatggagcgggccgcccgcatggagcgggggcggctcacccgcccggcggtggacgccctctatgggaggcgggtgcccatgtccgcctcccggatggacaagtacaagtcctgccacttctcctactttatgcagtacggcctgaaggccgagccccggcgggccgccgggttccaggccccggagtacggcaccttcgtccactatgtgctggagcacgtgctgcgggcctgccgggagcggggtggcgtgaaggaggttccggcggaggagctgcgcaccctggcccaggcggcggtggagcggtacgtcagcgaggagctgggcgggctggagcacgagaccgcccgcttccgctatctgttccggcggctgctcaaatcggtgtacgccgtggtggacaacgtggcggaggagctgcgctcctcccagttccagcctatttccttcgagctgggcttcggcgcggggaaggacctgcccccggtggagctgagtgtggacggcatgacggtcagcatctccggcttcgtggaccgggtggacggctgggagcacgacgggcggctctatctgcgggtcgtggactacaagacggggcgcaaaacctttgatctgacggatatctggaacggcatgggccttcaaatgctgctctacctgttcaccctggagcgagagggggaagcgctttacaaccgggagatcatcccggccggcgtgctctacctgcccgcccgggacgcggtggtcgcgggcagccgggccatgagcgaggccgagcgccggagaaaggtggacgccgagctgcggcggcgcggcatcgtgctggacgagccggaggtgctcgccgccatggaggagccgggggaggcgggcatccgtttcctgcccgtgaaggtgaacaaggccggggccatcaccggcgaggcgctggtctccgctgagcggctgggcaagctggcccggcacaccgggcggattctggaggagattggccgggagctggccgccggcaacatcgccgccgaccccttctggcgggggccggatcacaatgcctgccagtggtgcgagtacgccgccgcctgtcacttcgaggagggtcggggcggcgaccgacggcgcttcctgcctgccgtcaggggcgaggaattctggcaggcggttgcgaaagagcaagtatgagttgggagcccagatacagcccggagcggaactgttcgtcgctctcgatggcggagagcttgcacagctccgaccagaagtcgtccaggaacgcggcggaggagccctttccaaggcgggtcatgtaagtatcgacaacggcaagctgcttgcggtattctggagaagtctcatggatcatcaactgctgtaattctaagagatcaaacgtgatagaacctccttttgttgagaataactctatactcgttgtagtgagaataactccacatgtcaagagaggagcggaaaatggccacttttgaggagcggcttacaaagctgcgtacgaaagcaggggtgtcacaacaggcgatcggggatgccttgaacgtgtcccgctgggcagttcacaattatgaggcggggaaaaaccggccggattttgatggcctgatcgccctggccgactatttcgacgtctccctggattatctggtcggacgctccgaccgccgggagcgcaacccgtaggggcggcccttgtggccgcccgcagtcaggagcaggcccggccctgttggaattgcaatcggtcaaacatagcaatagatacctctgaacaggaacaaattgagcctgttgataaattgggggaatcattatgacgtttggacagagactgggcatgctgcggaaagaaagaggttatacgcaaaagacctttgcacaggagctgagcgtaacagagcggtgtattcgggcctatgaaaatgagacgcgccatcctgattactttggcctgatcgccctggccgattatttcaatgtttccctggactatctggtcggacgctccgaccgccgggagcgcaacccgtaggggcggcctttatggccgcccgcgggcgaccaccagggtcacccctacgccgttatgtactggggcgggtcccctgctggatgtacccctgtagatgggggctgactctaggccttgtttgaaaaatagcaatatgaccagcggcgaggaattttgcccgctggcaagcaattttttcgcaggaatcctggcggatttcaaggaaaaattgggccgtccagagggcaaaaggcccggtgattgggcgtgttgactattttcaaacaaggcctaggcacagaatagtaaaaagcaaagaaatgaaaagagaggaatatctgcgcatgatcaattttggagcgctcttgagcaacaccagcaactttctgtatacctacattctcatcgccctgctgatttttgcggggatctacttcaccgtgcgcacccgcggggtgcagttccggctgttccccgaggccctgcgggtgctgggggagaagaaaaaggacggcaaggacatctcctccttccaggccctgatgatctccaccgcctcccgggtgggcaccggcaacatcgccggggtggccaacgcgatcatcgccgccacggtcatcggcggctacggcgcggtgttctggatgtggctgctggccctcatcggcgcggcctccgccttcattgagagcaccctggcccagtgctacaaggagaagcacggggacaactgggtgggcggcccggcctactacatccagaaggccctgggcagccggttcttcggcgtggtgttcgcggtgctgctcatcgcctgcttcgcctacggcttcaacgccctccaggcctacaacgccggctccgccctccagtactacctgcccggctattccgagagcatctggcccgcggtggtgggcgcggtgctggccctgctcaccggcctgtgcatcttcggcggcgtacgccgcatcagcgccatcacctccggcatcgtcccggtcatggcggccatctatatcgccctgggcctcttcatcaccgtcaagaacatcggccaggtgccctatatgctctccatgatcgtctcccaggcctttgatccaaaggccatgttcgcgggcatcggcgcgtcctgtatcatgcagggcatcaagcgtggcctctactccaatgaggcgggcatgggctccgcccccaacgcggcggcggccgccgacgtgtcccacccggtgaagcaggggctggtgcagatgctctccgtgttcatcgacaccatcctcatctgctccaccaccgccttcatgctgctcctctccggtgtgcccatcgacgcctactccgagggcatgaactttgtccaggcggcggtgcacagccaggtgggccccttcggccccttgttcatcactgtctccatcttcctgttcgccttcagttccctggtgggcaactactactacaccgagtccaacttccgcttcatccgggactccaagaccgggctgctggtgttccggctgacctgtgtggccgccattttcattggcgcccagatgagcttctccatggtgtgggatctggccgatgtgctgatgggcctgatggccctggtgaacctggtggccatcctgctgctgggcggaaaggccatccgggtgctcaaggactaccagaagcagcgcagggcggggaagaaccccgtctaccgctacgacgaggtgggcgtgggcagcccggagatctggaacgaagcccacgccaaaaagtgggaggactgaaccgaacccatccccgctgagctgaaaggagcgccctatggccttttccctgacaagtgaacagcaggccgcggtagacaaccggggcggcgggctgctggtgtccgccgccgccggctccggcaagacccgggtactggtggagcggctcctggcccgggtggagggggaggggctggacatcgaccgcttcctggtcattacctacaccaaggccgccgccgccgagctgcggggccgcatcgtggaggagctgtccgcccggctggcggagcgccccaccgacgcccacctgcggcggcaggccaccctggtctataaggcccagatctccaccgtccacgccttctgcgcccagcttttgcgggagtgcggccacctgctggagctggatccggacttccgcctgtgcgacgagggggaggcgggcatcctcatgctccgcgccctcaacgatgtgctggaccggcgctatgaggacatcgccgaggggagcgacttcgcccggctggtggacaccatgtccgccgggcgggacgacagccggctcatgcagatcgtgctggacatccgggggcgggtgcaggcccaccccaatcccgccgcctggctggacgggcaggagcgggcctttgccctggagggggtagacgacccgggggagaccccctggggccgcctgctgctggacgacgcggggcggcagggggcctactggcgggacaagatcgcccgggccctggagctgtgcccctgcgacgccaatctggacgccaattacgcccccagcctctccgccaccctggcggccctggacgcctttgtggaggggacgcggcgggggtgggacgcggcccgggccgccctgcccatccccttcccggcggcggggcgcaagaagattgtggactgccccgacgcggcggagcaggtgaaggccatccggagcacctgcaaaaagcggatggagaagctgggggagtggttcgaggactgcggggcggatctcctggaggatctccgggcggtgcacccggcggtgcgggggctgttcgccctggtgaaggacttcgagggggcctacgccgccgagaaggcccgccggggcatggtggacttcgccgatctggagcacatggcggtgcgcctgctggtgggggaggacggagctcccaccgagctggcccgccagtggtccgcccggtacgacgagatcatggtggacgagtaccaggacaccaacgaggtgcagaacgccatcttcaccgccctgtcccgggaggggaggaacctcttcctggtgggggatgtgaagcagtccatctaccgcttccgcctggctgatcccaccatcttcctgggcaagtaccgcgcctttgccgactacacccgggcggcggagggggaggagcggcggctcatcctgtcccggaacttccgctcccggccggaggtgctggagggggccaactttgtgttccgcagcgtcatgtccgccgacttcggcgagatggactacaccgccgacgaggccctctaccccggcgcgcccttcccgcccgacggccgctacgccgtggagctggacgcggtggacgcctccgccgagggggaggaggagaagaccgcccgggatctcatcgaggcccgctttgcggccaagcgcatccgggcgctggtggacgggggctttcccgtctccgacggcgagggcggcgagcggcccgtccgcccggcagacatcgtgattttactccgctcccccaacacggtgctccaccactacgcccgcgccctgggggagcggggcatcccctgggaggcggagggcggcggcgacttcttcgccgccaccgaggtgaacgtggccctctccctgctccagatcgtggacaacccaaggcaggacgtgcccctcatctccgtcctccgctccccggtgtacggcttctccgccgaccggctggcggagctccgggccgccagtcccgacaccgacttctacgccgccctggccgccgacgggggggaggacagccgggcctttctggccgagctggacgagctgcgcttcggcgcgggggagttgagcagccacgagctgctctggcagctctacgaccgcaccaatctgctgggggtgttcggcgcaatggaccggggggaggagcggcagtccaatctgctcaccctggcggagctggcccgccgcttcgagggggcgggccacaagggcctgttcggctttttgtcctacctgacccggctgcgggagaacggggccaagctggccctgcccgcccccggccgggaggggggcggcgtgcgcatcctgagcatccacaagtcgaaggggctggagttccccgtggtgctcctctgcgggctggcgcgaaggctcaaccgggaggacatgagccggcccatcctgttccaccccaagctgggggtgggccccaagcggctggacgtggagcgggggatggagtatcccaccctggcccgccgggcggtggcccggaagctggagctggagatgatggccgaggagctgcggctgctctacgtggccatgacccgggccaaggagaagctgattttgtcggtggccctcaccggcggggcgcgggatctggagaagctggcccccgacgcggcctgcccggtggagccccaggtgatggccgggtgccagagcgtggggcagtgggtgctgctgcccgccctggcccggcccgacggggaggccctccgccgggccgcgggggtgcaggtgcccgtcccggcggcggacttcggcccggcctgggatatccgctttgtggacggggcggagttccaggcggagccggaggagagcgccatttccccatccggtcccccggacggcgagatgatttccgcgggggcgggggaggagaccgccgtcctggcggcccggctggcctggcattatccccacggggcggaggtggagctgccctccaagctcaccgccacccagctcaaggggcgggcgctggacgaggaggtggccgaggcggcggtccggcccccccggcccatccgcctggggcggccccggttcgccgccgaggagttcggcctcaccccggcccagaagggcaccgccctccacctggtcatgcagtacatcgacttcgagcggacggagcgcgtggagcaggtccgggccgagatcgcccggctggtggagcgggccttcctcaccccccagcagggggaggcggtggacccggccaaaatcgcggcttttttcgcctctcccctggggcgggagctgatggcctccacctccctgcggagggagttcaagttctccatcctggttccggcggcggactactacccccaggccggggcggaggagcaggtgctcctccagggcgtggtggactgctgctttgagactctggagggcatcaccgtggtggacttcaagaccgaccgggtggaccggcgctctgtagcggcccgggcggaggagtaccggccccagctcgcggcctacagccgggcgctggaggagatcaccgggaagccggtgatccgccggtgcctgtggtttttcgccctggatcaggtggtggatgtgtgaagggccgctggcaacttgaaaaatttctcgaaaaaacagttgcaattccggttttcctgtgctatactattctagcgtttataaggcgtggaggtttgctgcgccgcctcatccagaacgagaaagaggtgaacacaccatgaaggaaggcatccatcccaactacgaacagaccacgatcaagtgtgcttgcggtaatgtgatcgaaaccggatctaccaagaaggacattcgcgtggaagtctgctccaagtgtcaccccttcttcaccggcaagcagaagatggtggatactggcggacgcgtcagccgcttcaacaagaagttcggcctggacaagaagtaagttcgtatgtaagagcccgtaccggtttcggtacgggctcttttgcatcggaaggataccagccgccggagcggcataagaataaggagggagacggctatgcgcaagtgcctgcgctgcgggacagagatggtggagggctggaacgtcaaggaggatgggcataaacatgaaattttcatcgacaatgggggaagcttcgtgcgcggcgacggacggatgggaattctgaaggccgcggtctgcccccagtgcggcgaggtttcggtttatgtggacgatccggacacggtgatcaacggatggaggtaagagcgatgtttagcagaattgaccccaaggagctggaccagaacgtcttttccatgatcggcgagcagtggatgctggtcaccgccgggacggcggagcggtgcaacaccatgacggccagttggggcggcctgggcgtgctgtggggaaagccggtggccacggtctacatccgcccccagcggtacaccctggaattcgtggagcgggagaactgcttcaccctctccttcttcggggaggaataccggaaggccctggccctgtgcggctccaagagcggccgggacgtggataaggtcaaggagtgcggcttcacggtggccggggcggcgtgcggcgcgccctactttgaggaggccgggctggtgctggtgtgtaaaaaggcgtactggcaggacatggacccgacccacttcctggacggagagctggacgggaagtggtaccccgaaaaggattaccaccgcatcttcatcggggagattgtggaagtactgaagaaatactgacgccggggctgcggcccgcggcgcggaggacggtatgacggaaaacgagacaaagcaagcgaaaaaccgggcggtgctggtgggcctgaatgcccactgcctgtcggccgaggaaaacgccgacgacacctccatggaggagctggccgatctgctggagactgcggggggcgtgtgcgtgggcaccgtgttccagaacaaggacgcccccgatccccgcaccttcatcggcgagggcaaggcggctgaggtgaaggagctggtgggggccatgggggcggacatggtggtggtggataaccccctgtccccctcccagcagcgggtgctgtcggaggagctgggcgtccaggtgctggaccgggcggccctgatcctggatatcttcgcccagcgggcccgcacccgggagggacggctccaggtggagctggcccagtaccagtatctgctgccccggctgctgggcatgtggacccacctggagcgccaggagggcgccatcggcacccgcggccccggcgagacccagttggagaccgaccggcggcacatccgccgcaagatccagaagctgcgggaggagctggagcaggtgcggcgggtgcgggccacccagcgcacccgccgggagaagaacgaggtgccggtggtggccatcgtgggctataccaacgcaggcaagtccaccctgctcaaccggctgaccggggcggacatccccgccaacaaccggctgttcgacaccctggacaccaccacccggacgttggagatcagcgacacctgcaccgtgctgctcagcgacaccgtgggcttcatccgcaagctgccccaccatctggtggaggcctttaaggccacgctggaggagctgagctacgccgacctgctcctccatgtcatcgacgcctccaaccccctgtggcgggagcaggcggcggtggtggagcagctcatcgtggagctgggggcggagcagaccccccgcatcgacgtgttcaacaagtgcgacaaatttaccggcgacatccttccccacggggcggacatcgtgtccatctcggccaagaccggccaggggctggacgagctgctggagaaaatcggcggccgcctggacaccggcgcctgccgggtggtgctccgcctgccctacgaccagggcggcgtggtggacatgctccaccggcaggctaaggtggagcgggtggactacggcgaggccatcgaggtggaggcggtgtgcacccccgtccagcttggccgcctgaaggactatatcgtgtcgggctggacgccccccaaggagccctgggaggactgagaggcgccgtaaacggcgtgataccccctccgcgctccgagggggatcaatgcttgcgatagaaggaggaaccgccatgcagctactggagactgaccgcctgctcctgcgccccttcaccctggacgatgcggaggggctgtacgcctacgccagccacccggaggtgggccccccggcggggtggcccccccaccggagcgtggaggagagccgacaggtcatcgagaacatcttcatcccctcggatgccctggcggtactccgcaagtccgacggccgcctgatcggttcggcgggcttcgtggaccggcaccgcgcggagctggggacgcccagcgaggagatcggctattccctggcccgggactgctggggccaggggctgatccccgaggcggtgaaggagattatccgccacgccttcgccgacctgggctaccaggccctgtgggcggcctactacgacggcaaccgcaagtccaagcgggtcatgcagaagtgcggcatgacctaccgcctctcccgtattgaagcggtggagcaattgggcgagacccggctggcccactactttgccgtcacccgaagggagtgggagcgatgaccgagtatttcatccccaccggagcgtccgagaccgagctggtggagaagcgctcccgctttctcggccgcgtctggccggtggagagcgaggaggaggccagggcccgcatagaggagatccggaaaaagcactacgacgcccgccaccactgctggtgctaccgcatccgggaggggggcgtggagcgctactccgacgacggggagcctcagggcacggcgggccagcccatgctcaacgtcttccagcgggagggggtcaccaacgtctgctgcgtggtgacccgctacttcggcggtatcctgctgggggcgggggggctggtgcgggcctatacccagtccgccaaggacgccctggacgcggcgggcatctccgtggtgcgccgctgggtggaggtggccgtgccctgcccctactccttctttgagcggctcaagctggagctggaggcccacggcggggtgctgggggaggtggagtacgccgccgacgtcacggtgcacgccctgctgcccgaggagcgggcggaggccttctccgcctggctcaccgagctggccgccggcggagtggccgcccaggtgtgcggcgagtccttccaggcggtgccccggacacaagtatgaacaaatcatgaatcttttgcaaaaaagaaggatttttccgaggaaagaagtatatagttacagagactgctgagaggtaggtggtatctgtgaccctgcgcgaacagaccgaggcgctggagcgggagatgctctccccctttgcatgcctgtcgtcccaatcccgggggcggcagacgccgctggagccctgtcccacccgcacctgcttccagcgggacatcgaccggatcatccactccaaggcctttcggcggctcaagcacaagacccaggtctttctggagccggagggggaccactaccgcacccgcatgacccacaccatcgaggtcagccgcatcgcccgcaccattgcccggggcctgcggctcaacgaggatctggcggaggcggcggcctacggccacgatctgggccacacccccttcggccacgccggggagcgggtgctcaatgaaatcctgcccggcggcttcgcccacaatgagcagtccctgcgggtggtggaccggctggaaaaggagggggagggcctcaacctgacctatgaggtgcggcggggcatcctctgccacaccggccccgaccgggcggagaccctggagggccagctcctccggctggccgacaagatcgcctacatcaaccacgacattgacgacgccatccggggcaggatcatctaccccatggacatacctctgtccatctcccaggtgctgggcttcacccactcggagcggatcaacaccctgacggtggacatcatcacccagagcgccgggcgggacgcaattctccagtcccccgcctgccgggacgctatgggcgagctgcgggcgttcatgttcgagtttgtctaccgcaatccggtggccaagggggaggaggggaaggcccaggagctgctccgccgcctgttcgactactaccggcgggagccggacaagctgccaccggagtttcaggacatcaggatggaggagggcgtggagcgggccgtctgcgactatattgcgggcatgaccgacgtctacgcggtggagtgcttcaacgcggcgttcattccgaaatcctggagcgtgaagtaggcgcggacaggcaggccgcgcgggagggtataagcctggtatattgtggaaaacatagtcggaaggagggcgcggcgtgccgattcccgaacaattcatcgacgagctggtggcccggagcgagatctccgacgtggtttcctcctatgtccacctgacccggaagggaaacaacctgtgggggctgtgcccctttcacaacgaaaagacgccctccttctcggtttcgccggataaacagatttaccactgcttcggctgcggcaaagggggcggggtgatctccttcatcatggagatcgagaacctgccctttcccgacgcggtgcgcctgctggcccagcgggcggggctggaggtgcccgacgcaggcgccgatgacgccgggcgcaaaaagcgggcccgggccctcgcggccaaccgggacgcggcccggttttaccacgactacctcaagggccccggcggtgcgcgggtgcgggactatctggcccagcggcagattgcgccgcgcaccgccacccgcttcggcctgggggcggctccggagcagtgggacgcgctgaccagggcgctgaccgccaagggatacagcaagatggagctcatcgacgccgggctggccgtggcgggcaagaacggcggcgtgtacgacaagtttcgcgcccgtctcatgctccccgtcatcgacgtgcggggggaggtggccggcttcaccagccgcatcctgccgggggaggagggggccaagtacctcaacaccccggagaccattgccttcaagaaggggcggctgatctacgccctcaactttgccaagagcaccaagcggcccaatctggtgctggtggagggcaacatcgatgtcatcaccctccaccaggcggggtttgacaacgtggtggccaccatgggcaccgccctcaccgaggagcacgcccggatactggcccgctacaccaaggagctggtgctctgctacgacaacgacgcggcgggtaagcagtccaccgaccgggtgctcaacattctgaaaaacgccaacctgaacgtccgggtgctccagctccccaacgcctacgacgcggagggaaagcccatcaagcaggatccggacgactttgtgaagaaattcggcccggcggcctttgagaagtgcctgaatggcagcgcgggccagaacgactaccggctggagaccctccagcagaagcacagcctggccgacgaggaggggcgcatggcctttctcaaggaggcggtagagacggtggcggcgctccagagccccatcgagcgggagatctacggcaacaaggccgcggccgccgcgggcatttcggccggggcctttgcccaggaggtggagcggttccgcaagaaccgggcatggcaggcccgcaagaagcaggcccgccgggagctgacgccggcggcccagctccagccccgggagcgggagctgcggtatgaaaacctccgctccgcccgggcggaggagggggtggtgaggctgttgctgctggagcccgacctgttcccccaggtggaggggctggggccggagcagttttccgccccggtgctggccaagatctacgccctgctgtgccagcgccaccgggaggggcgctccacccagttggccgccctcgccggggcgctctccccggaggagatgagccacctggtgagcgtgatggatcagccggaggccctggcgcacagcgctcaggcccttcgggattacatagagatcattgagaccgaggccctcaagcggggcggggcgggcgcaagcgaccccctgctggcggcacgggagaagttcagagaaagaaaagcgtatggaggataaccgcatgagtgaaaagaagaccaccagcaagaaggtacacaccctgaccctggaggatcagaccaagctggcccaggccaatgtgaagaaaatggagcagggcaagatcgaggtcatgaaggtcgtcgagggcgtccagggggcggaaaagctggcggagctgatcgagcggggcaagaaaaacggcaagctctcgtccagtgagctcatggatgtgctggagaacctggatctggagagcgaccagatggacaagatctacgataccctggagaacctgggcatcgacaccgtgggcgacgactatctgcccgagctggctgacgatatcatgccccccctggaggagctcaacgagattgaggagctccccgaggaggagatggtggaccccaatacgctggtggactccttcggcatcgacgaccctgtgcggatgtaccttaaggagatcggcaaggtgaatctgctcactcccgatgaggaggtccagttggcccaggatatgggggccggcgacgcggccaaggagcagatggaggagctggagcaggcccggaaaaacggcgaggaagtctccatcaccgaggaggaggagaaggaactgcgccgcctggtgaagcggggcgaggccgccaagcagcgcctggccgaggccaacctccgtctggtggtgtccattgccaagcggtacgtgggccgcggcatgctcttcctggatctgatccaggagggcaacctgggcctcatcaaggcggtggagaagttcgactacaccaagggctacaagttctccacctatgccacttggtggatccgccaggccatcacccgggccatcgccgaccaggcccgcaccatccgcatccccgtccacatggtggagaccatcaacaaggtcatccgcgtctcccgacagctcctccaggagctgggccacgacccctcccccgaggagatcgccgaggagatgagtatgcccgtggacaaggtgcgggagattctgaaaattgcccaggagccggtgagcctggagacacccatcggcgaggaggaggactcccacctgggcgacttcatccccgacgaggacgcctccgagccgtcggaggccgcctccttcaccctgctcaaggagcagctggtggacgtgctgggtaccctgacccccagggaggagaaggtgctcaagctgcgcttcggcattgaggacggccgcacccgcaccctggaggaggtgggcaaggagttcaacgtcacccgtgagcgcatccgccagatcgaggccaaggccctgagaaaactgcgccaccccagccgttccaaaaagctgaaggacttcctgaactgagacagtacagcgacgagacgaggcccggaactgtatggttccgggcctctggcctgtcaaagacctcccgcaaaggaaagccgcgcagagttcctgcggccgcagccgcaggaataaagcaaaaatccgtcgtttccggggacatgtgcctcggaaatgacacctctcatagcagaaggggcgactatttcgctggaaatcgagtcccttccgccatgctgtctttctcgaaaaagttgcgctgccactttttcgacacgcaggcggggcccggaaccgtcaggttccgggccccgctgcgtctcctatgcctcggttccggggagcgggccgcgccccccgtcctggtaggggttgacgtaatccggcgggcagaggtgcgtttcgctccacagcagcatgtggttcagcacaggcagaaagctctcgcccatggccgtgagggtgtactccacccggggcggaacctcgggatagacctcccggtggagaaagccgtcggcctccagctcgcggagctgccgggtcagggtggactgggtgatgccgtccaggcggcgcagcagcgccccgaagcgctgtacccggtagaaggccacataccacaggatcaggattttccacttcccgctgagcaccgcctgcaggcggctcatgggaaggcagcgggccagcgcctccggcgtctggaatttgttgtctgccattgcgttccctccctgtcctgacattatagcgggaaaccggaaaaaagcaagacaggatcaaaaaagataccggggcgcaaaaaagaccgtacttgaagaacgggcgggggcaggctatgctgaacgggacaaaccacaaggaggcaaactgccatgcactacacaggcaccatctggcgtccgccctatgaatccggctccctgctgctggaggcggccgccggctgcacccaccaccgctgcaagttctgcacgctttacgacgagctgcccttccgcttccggctctctcccctggaggacattgaggcggatctggccgaggcccaggagctgctccggggacagctcgtccagcgggtctttctggtgggggcaaacccctttgtgcttcagacggagcggctgaaggccatcgcggggcgcatccgcaggtacttcccggagtgccggaccatcggctgcttcgcgcgggtgaccgatgtgggacggaaaaccgatgaagcgctccgggagctccgccgcctggggtacgacggcctgaccatcggcgtggagacgggatacgatccggcgctgcacttcatggacaagggctatcaggcgcgggacatcgtggagcaggcgcaccggctggacgaggcgggcatcgcctatcactttttctatctggccggaattgccggggccggacgcggagaggcggcagccctggccagcgcgtcggtgttcaaccagaccaacccccgcatcctgggcagctccatgctgacggtctatccccagtcccggcttttttcggagatgcaggccggccggtggacggaggccggggaagtggagaagctggaggagctgaaaaccctggtggagcacctggagcggcccctctattttgcggccctgggagcgtccaacgcggtttcggttcacggctttctgccggaggagcgggatgccgtggccgccaagctggcgcgggcctgccgcccggagcacgaggacgccctgcgccgttaccgggccggtctgcggcatctgtagtggaaataatgcttgaaaaacagataggaatagtataatatagaaaaggaaagaaagtgggcatactggtttccaaaggaggcatgcaggttgaataacattcagaaggcggccgtcatcggctgcggctttgtaggctccagcattgcgttcacgctgatgcagagcggcatcttttccgagctggtgctcatcgacgccaaccgggacaaggcggagggggaggccatggatctgtcccacggcctgcccttcacccaccccatggacatccgggcgggggactacgatgacgtggccgactgcgccctggtgatcgtcaccgccggtgcggggcagaagccgggggagacccggctggatctggtgcacaagaatgtggccattttcaggagtatcatcccggagatcgcccggcgcaatagggacgccatcctgctcatcgtgtccaatcccgtggacgtgctcacctgggcggcgtggaagctgtccggctacccggccaaccgggtgctgggctcgggcacggtgctggacaccgcccggctcaagtacctgctgggggagcgcctgggggtggacagccgcagcgtccacgccttcatcatcggcgagcacggggacagcgagctggcggtgtggagcggggccaacgtgtccggcatctccctggatcacttctgcgagctgcggggctactacgagcacgacaaggccgacgagtggctccagcgggaggtgcgggacagcgcctatgagatcatccgccgtaagggggccacctactatggcgtggccatggcggtggagcgcatcgtccgcgccatcgtgcgggacgagcactcggtgctcccggtgtccaacctgctccagggccagtacggcatcgacggcctgtgcatgagcatacccgccgtggtgggccggaacggggtggaggacaccctggagatccccctctccccggcagagcgggaggccctgcgggactccgccgccaccctgcggggcgtggtggatagcctggagctgtgagaaaatgcgaaaacggagcccggcgctgatatgtacccagaattctggacacataaaaaattgaattaggtgcacatggatgcctctctgaattttgtaggaggcatccattttgttttctcttggattctttcgttgttgtagtaatttatgtagccgtcaacagccttggcaaatgtttcaaaagaggaatactctttttcatgcccgtagaacatctcgtttttcatccgtccaaagaaggtctccatgatgcaattgtcgtaacagttgcccttccttgacatggattgaatgattttgtgatctttaagtgcctgcctgaagtacacgtgctggtactgccacccttgatcagagtgaaagatcaggccatctacagagggaaacttcgtaaaggcgccggccaacattctctggatctgttccatattggcactttgagataaatcataagaaatgatttcgtttgtgttcatgtcgagtataggagagagataacacttcccccacgaaaaaccgaactgagatacatcggtagtccatttttgcataggagctgtcgtgctgaaatcccggtcaaggatattctcagcaaccttgccgacctcgcccttgtaggaatgatacttttcctttgggcgctttcctgccaaccccatagtgtgcataagccgttgtacccgcttatgattgaccttgtggccgcgctttatcagttcctgatatactcttcgcacaccgtagcggcctttatgctgtgagaaaatgtctttgatttcatctgccaagcaatggtttcgaacagcaacttgatcggccttgctcaactcaaaataataggtagaccgtgccatctgcatagatttcaacagatatttcaattggtatcctttttcacgcagctctttgatgatcgctgctttctcgccttgagttgcgctgcgtgcctctcttctctcaaggcgatctctttttttataacttcattctccgcctttatatactcgttttctgcccgaagccggatcaattcttctcgttcggattcattcagtggccttgcttcttcctttttcatttggggtacccctttacttggacgaccttttttcatttctaccaggccattatacccctttgttttatagttttgaacccattgatacaatagtctatcttgaataccggcctcgattgccactgacacacaggattttccggacattacttgggatactagttccagccgttcttctggtgtccagttcctgttgaaatttttgtgtttcagtgcttctggaccgcggctatcctctgctcttacccatagtctcactttatcccgaaaggatttatcgctaacaccttccggcgtttctggccattttccttctcgatacagttctacacatttccttttgtactcatatgtgtaccgcataataataccccctctactgggtgtccagtaaagggggtacatatcacgcacaaagcgcgccgggctccgttttttgtccgcccggctcaggggatcaccagccaggctacccgctgggcgttgtcggagggccagttgtcataggccgcgctcatggagacctgccaggcatcctcaaacacagcgtagcaggcggccagcttcccgtcctgggcggcgggggcttcaagcatctccaccggctgtccgtctaccagagcggtggtgctgcccggcgtcagagtgatggtgacgccccggtaggtcatggcggcggtctgggcctcgttgctccatacgcagtccacccccagcccttcacacagggcccggacggggacgctgtagccgccgccctccgacaggcggtccatcaacgggatctggaagggatagagggcgggatctatctctacaggctctggtctgccgccgtccaggggataggccatgccgttgaacactaccgcatccacctgggagagctccagcacagagcggagcggatgggcgtagtcgcaatggattgtgcctcgatcgttccaggaggtggggccaagcaaattgtcgcccacgatctgcccccagccgcacagggagccgtcggtcatgcggaagaaaagcagggggaaagcgtcgccgtccgcgtcggcaaaggagtattccatctgaatggagagaggagacagactcacggtttccagggtaacaggggcaccaccctcaatgtgatcaaaggtgccggaaccggtaccctcagcgttaacctccacggtaacaggctctaccggctccacgggaatctccacgtaggcgccctcctccataaggcccagccggagctgcacggcgtagacggcggcattcagctcatcgactctcatactgtaggtgcgggaggtctccgtgcgcagcgcctccttttccccatagctgaatccacctgccacgggcatctcgacggcagggccgtttccggtaggagtgggctccggcttgacggcctcgttctccagagcacggacagagaaggtgtccatgttctcgaagtcatccgccatgagggcggcggctgccgcgtcgtttttggcatcaatggtgaccagcagataggcggagctggtgtccgccaccgagctgatcaccgacagggtgtagttgtcgtcacggatggaatatgtctcatggcttacgtagtcctcaaccggggtattgtccccctcaaagtagaagtccagcacgttccaccggctggctacggccagggcggagccggccagcagggccgcgatggcggccgccgccgcggcaaatcggagtttctgtctcatataggctctcctttccgaggggacggcgttcagcgcggcgttgacccgccgcttgaccgccgccgggtcggcctggggacagggcacgcccaccggtactgcgccgtcccacagctcctgcatccggtctctcacgcctccacccctcctttcgtcaatgtatcccgcagggtcttccgcccccggaacagccgctgcttggcggcggtctgggtcaggcccagggcacgggcgatgtccttgagcttgtcgccgcagtagtaatagcgcaggaacagggtgcggtcgggctcgtccagcccctccaccgcgtcccacagccgggccgcccactcccgccgctccgcctcggcctgggggtccgcgccgccgggggcggcggtgtcctccggcagaggggcggcctctttgtgggtgcgtagccagtccgccgccctgttccgggccaccgtccccagccagggccgcaggccctgctccgggttcagctccccggcgtgggcccacagggccaggaatacgtcagcggtcagctcctccacgtcctcccgggcgccctgcccggccagcacccgcaccacgacggcgctcacatagggggtgaagcggtcgatggcccgctccagggccaggcggctgccctgccggagcttctttgccagcgtgatctcgtccagcttgtccccctcctctccaagaaccggttctatcagtatatacgaagcgggggcggtttggttacggaacaggcaaaaaaatttccccgaggcctagcctcggggaagaaaaggagctcagtgcaagtcgggcagggcggcgagcaggccgtccacgtcctcctgggaggtctggaaacaggtgacgaagcgcaccacggtatggctcccgtcataggggcaccagtcctcgtaatcgcacaccgcgtcgagctggggcttgagggcgttgtccaccacggcgaacacctggttggtgggggagtccacccacagcgtccaccccttggccctcagcccgtcctggaggcgggcggccatttcgttggcgtggcgggccatgtggaagtagaggtcgtcggtgaacagggcctggaacatgacgccctgaatccaccccttctccattaccgcgcccatgcgcttcttcatgcggaagaagccgtcggtcagctcgggccgggtgatcaccagggcctcgccgaacatggcgccgttcttggtgccgccgatgtagaaggcgtcgcacaggcgggcgaactcaggcagggtcagatcgttggccttggaggtgagggcggcccccagacgggcgccgtccacgaagaggagcaggccgttctcccggcagaaggcgtacagggcggtcagctccgccttggtgtacaccgcgccgttctcggtggcattggagatgtagaccaggcccggcttggtcagatgggggtcctggtggagggccagcaggggaggcagcatctccggggtgatcttgccgtcgccgcccacgggcacggggaggatcttgtggccggtggcctcaaacgcgcccacctcgtggccgttcaggtggccggagtcggggcagatggccgcctcccacggcttgagcaggaaggagcaggccaccacgttggtctgggtgccgccgatgaggaactccaccatggcgtcggggcagccgcacacctcccggatgcgctccttggcccgggcggtgtacccgtcgtcgccgtagccgtggttgccctccaggttgacggcgcacaccgcctccagaaccttggggtgggcgccgaaggagtagtcgttgcggaagagatactttttcatcacgcatacctccagttgttttgcgaaaaaggcgggcggccgcaggccggggtgacctgcggtcgcccgccgccgttctgtggcttaaaatttgaaggagtccttgaggctcaccgagcggttgaacaccagatggccgggggcgctgtccttgttgtccacgcagaagtagccctggcgcaggaactggaaggaggcgggggcctccgcaccggccaggccggcctccaccttggcgtgggggagcacctccagggagctggggttgaggcagtccaggaagttcttgtccccggcgtccggctcggcgtcggtgaacaggttgtcgtacagccgcacctcggcgtccacggcggtggcggcgtccacccagtggatggtggcccccttcaccttgcggccgtcggcggggtcgcccccccggctgtccgggtcgtactcggccaggatggcggtgacgttgcccgccgcgtcagtctcatagccggtgcacttgatcacataggcgcccttgaggcggcactccggcccgtcggggtagaggcgcttgtacttgggcaccggcgcggggagaaagtcctccgcctcgatatacagctcccgggagaaggtgacctcccgcgcgccgtcctccgggcggttggggttgttctccacggagaaggtctcgctctgtccctcggggtagttggtgatgatgaggcgtaccgggcggagcaccgccatgcgccgctgggcggtctcgttcaggtcttcccgcaggcagtgctccaaaaaggcgtactccacggtggaggccgccttgctcacgccgttgcgctcggagaaattgcggatggcccggggggtgtagccccgccggcgcaggccgcagagggtgggcatgcgggggtcgtcccagccggatacccggccctcctccaccagctggcgcagcttgcgcttgctcatgacggtgtagttgatgcccagacgggcgaactcgatctgccggggcctggcggggacggggcagttggcgatcacccagtcgtagagggggcggtgatcctcaaactccagggagcagagggagtgggtgatcccctccagcgcgtcctccagggggtgggcgaagtcgtacatggggtagatgcaccacttgtccccctggcggtggtggtgcatgtggttgatgcggtagagcaccgggtcgcgcatgttgaagttgccgctggccaggtcgatcttggcccgcagggtcatggccccgttggggaactcgccggcgcgcatccgggcgaagaggtccagagactcctcgatgggccggtcgcggaagggggagcgggcgggagtgttcacgtcgccgcggtactccttaaactgctcgggggtcagctcgcacacgtaggccaggccctttttgatgagctccacggcgtactcgtacatcttctcaaagtagtcggaggcgaagaagaagcggccgccccagtcgtagcccagccagtggatgtcctcttggatggcctccacgtactccacgtcctccttggtggggttggtgtcgtccatgcgcaggttgcacaggccgccgtatttctcggcggtgccgaagtccacgaagatcgccttggcatggccgatgtgcagatagccgttgggctccggcgggaaccgggtgtggacggtcatgccttggaactgaccaccctgggcgatgtcctcgtcaatgaaatcatggatgaagttctgcgtcatggtgggtttcagctcttctggcatgtaaatcactcctctttcttgatacgaactcttattttaccctgaacagcgggaaaaagcaagagagggaggacattccggcatattttttccagaagggcggagaaaattgcataaaagggggcgtgggaagggggagagggcccggatagttgtcacaaagtgcgggaagggaggcccaaagcccttgacagagggaggcggaacacggtatacttacgacaatcgttgtgaacaaaggcgttccgaccccaagggcggagcgccttcatttttaaagcgaaaggggcggcagaccatgggggtctacagcaaagaggacatcatccgcatcgtccgggaagaggaaatcgagttcgtgcgcttgcagtttaccgacattttcggcatgctcaaaaacgtggccatcaccgcgtcccagattgaaaaggcggtcagcaaccagtgtatgttcgacggctcctccattgagggcttcgtccgcattgacgagtctgaccagtacctctacccggatctgaagagcttccgaatcttcccctggcggcccagccacggtaaagtggcccggctgatctgcgacgtatacaacacggacggaacccccttcgtgggcgatccccgctatgtgctcaagcgggtgatccagaaggccaacgacatgggctacgaccgtttcaatgtgggcccggaggcggagttcttcctgttcaagaccgacgaggagggcaagcccaccacccagaccaacgacgaggcgggctacttcgacctgggccccctggatcacggggagtccacccggcgggagatctgcatggcgctggagcagatggactttgagatcgaggccagccaccacgagtgcgcccagggccagcatgagatcgacttcaagtacgccgaagccctccacgccgccgacaacatcatgacctttaagctggcggtcaagaccctggcccagcgcaacggcctccacgccaccttcatgcccaagccgatcttcgggatagcgggctccggtatgcacaccaacatgtccctgttccgcaacggcaaaaacgccttctacgaccccgacgatccccgcggcctgtccaaggaggcgtacagcttcatcgccggactgctccaccatgtgcggggcatggcggcggtgaccaaccccctggtcaactcctacaagcggctggtgcccggctacgaggccccctgctacctggcctggtcggcctccaaccgctccgccctcatccgcatccccgccagccggggccagggcacccgggtggagctgcgctcccccgacccctcctgcaacccctacctggccttcgctgtctgcctggccgccggcctggacggcatcgagaagggcatgacgcccccggcggagatcaccgagaacatctacgccatggacgccgccgcccggaaggcccacggcatcgagagcctgcccggctccctggaggaggccctccgcgccctggaggccgaccagttgattctggacaccctgggggagcacgtggccgccaactacctgacgggcaagtggcgggagtgggacgagtaccgtacccgcgtgtcctcctgggagcgggagaagtacatcatcaactattaaggccccgtggagacggtggtcgtcgcctttgagggcgagaaaaacggccggagactcaaggagctgctggagagctccgggacggccgcctgcctgctctgccgctccgcggatcaggtcaagcgcctggtccgccagcagcggctcaccgccgtggtgtgcggctataagttcccggatgggacggcggaggagctggccggggagctgcccggcttctgcacggtgttgctgctggccccccgcggcctgctggagctggtgccggagcgccccggactcctccgcctctccgcccccgcaggcaggcgggagctgctcgccgcggtggaggagctgcttcggctgggcgaggaggccggagccctcctgccgccccggcggagccgtgaggagcgcgaggtggtggagcgggccaaggagcggctgatggcgcgcaacggcatgaccgaggaggaggcccaccgggccctccggcggcggagcatggactgccgcatccccctggcagacgcggcgcggatgctcttggacggggagcgtcccgccccttgacaaaggggaaaaattggcgtagtatgtctttcgacaacttgatagcatggacagtgccgccctccggggcggataaaagggaatcgggtgcaaatcccgaacgatccggtcactgtaagcggggagccggccgcagacgccattgtggagacacgagaaggcgcggcccggcggagagccgcaagtcaggaaacctgctgtctgtgcagaaggataggtgtcttccgcagaaagtagcctgtctgtttgccgccgtgtggttcgattgtgcccatggcgatgagcagtcccgctttccgccggaaagcgggatttttctgtccacagcacaaaaaaggaggattatcatgaaaaagctcgtacccctgaccctcgccctcgccctgggcctgacggcctgcggcaccgccggccagaatccggccccggcggccagcccaactcctgcgggggatgtccagggcacggaaaccccggcaaacaccgagggatttccctttaccctgaccaccaaggacggcgcggaggtcacatttacccacgtgcccgagaaggtcatcgccgccaacggcaacgcgggcgaccagttaatggccctggggctgggggataagatcatcgccaccgcctacaccaactccgacatcaaccccaagtgggacgcggagtacaaggccatccccgaggcggcggagacctacatctccctggagaccgttttgagcctggagccggacttcgtctacggccgctccagctcgtttaccgagaagtacaacaccgagcatgacaccctgactaagtacggcatcatgtccctgtcctccattgagggctacaccgtgggggccgatgtggacgtggtgtaccaggacttctacaacctgggccgcatcttccaggtggaggacaaggccgaggagatcgtcagcgggatgaagggcaagatcaccgccgccgaggaggcggtggcgggccaggaggccaccccggtgttcgtctttgacatggcccaggaggagggggcctatacctgcggcaacaacttcacctccaagctcatcgagcacgcgggcggcgtcaacatcttcaacgatctggacaccacctgggccaccgtgagctgggagacggtggtggagcgggcccccgaggtgatcgtcatcaacgattacggcgacacgaccctggaggagaagatcgcccagctcaaggagaaccctgccctggccacggtgcccgccattcagaacgaccgcattatctccgtcaagctgtgcgaggtgtttgccagttccatgacgggcgacacggtggagaagttcgcccgggccttccacccagactgcttcgcgtaagagggcggtatgaagcagttttgcaggctggtgaaggcccacacctttctgacctgtctggtgctggcggcggcgctcctggtgtccattgtcatcggcatcggcaccgggccggtggccattccctttgccgaggtgtggcgggtgatgttccaccggctgggcggcctgctgaccggctcggagctccccctggagggggtgcgggagagcacccagaacatcgtctggttcctgcgggccccgcgggtgctgctgggggccctggtgggggcggccctcaccctttccggcgtggggatgcaggcattcaccaagaatccgctggccgagccctatgtgctgggcatttcctccggcgcatcactaggcgcggtactggccatgctgctgggggtgtccctgcctgtgctgggccgcctgtcggtgtccgccggcgcctttgccggggcgctggtgtccatcctcctggtgtaccttctggcccgcacccgaaatgcggtgacgccgatccggctgatcctggtgggagtggcggtatccgccatgttccaggcatttaccaactacatcgtctataccgccccggacgacgccgccgtccgggaggccaccttctggatgctgggaggactgggcagcgcggagtgggccgacgtgcccctgctggccggcctggtgcctccggccctcctgctgatgctggccctggccaagcccctcaacgccatgatgatgggggatagctccgccgtcaccctgggagtcaacctgacggtggtgcgcaatgtgctcatcggcgtcaccgccctgctgaccgcctcctcggtggcggtcagcggctgcatcggctttgtggggctggtcatcccccacctggttcgctcggtggtggggccggatcaccggaagctggttcccctggccgctctgttcggggccatctttctcatctgggtggacgtgggagcccggatcatcaagccgccggcggagatccccgtgggaatcctgacggcgttcctgggcgcgcccctgttcctgtggatgatcaaggtgcgccgctatgaattccagtagggggtctgcgccatgatagaggcaaaacaggtccggtacggcatccgcagccgggagatcctccggggcgtggatttccgggtggagaagggggagttcgtggggctcatcggccccaacggcagcggcaaatccacgttcctcaaaaacgtctacaaggtgctccgcccccaggcgggggagctgaccctcatgggggacgatctgctggccatgagcaaccgggagatggcccagcggcttgccgtcatggtacaggagcaggaggccgccttcgacttcacggtggaggaggtggtcatgatggggcggcaggcccgcaagcggctgctggagagcgacagccgggaggaccgggcgctggtaggggagatcctggcgcgcaccgggctggcctccctgcgggagcaggggttctccaccctgtccggcggggagaagcagcgggtgcttatcgcccgggctctggcccagcagacggcggtgctggtgctggacgagccgaccaaccacctggacatcaagtaccagctccagctcatggagctggtgcgggggagcggatgtaccgtagtggccgccatccacgatctcaatctggccgcggcctactgccaccggctctacgcattgaaggacggggtgatcgtgggggagggcgcgcccaaagagctccttacccccgcttttctgcgggaggtgtacgaggtggaggcggaggtgctcaccggacgggacggctccctgcgggtgttcttttacccgtcccgcatatcataaaaacggcccccgggcagcgcccgggggccgttttattctgccagccagtcgaaagccaggcggggggtgccgtcctccacatagatggtgccgcaggggagaaagccgtgcctggcgatcagatggcgcatgacggcgttgttctcgtgggtgtcgatgcgcaggtgggacatgcgtctcttacagaagtccatacaggcggcaaacaggccgtgaaccgtgccgtcgccggccacccggtggatggtgccgtagggtgcgccggagcgccaggccccctcgatgacgcggtagttgggctcatcccccaggcggaggacaaaggccccgtggatgactccgtcctggtcaaagacgtacagctcaccccgctgcagatccgcctccagatcctccgggagggggtaacggtcgctccactgggtggggttgccgtgctcggccatgaagcggcgggccacgccgtagacgggacccagagcgggcagatcgtcgggccgcgccagccggatcataggtgccgcctctgcggaccccgcgcccggcccatcggcactcaagagggcttccagatggaccttttgcggcctcagaccgcaggattcgtaaaattttatggcggagggattgcagctccatacattgagcgtcagattatagcacccgcttttccgggcgaattccgccgcgtgggcatagagggccccgccgatgtgctgtgcccgaagcgcctcgtccacacacagatcatcaatgtaaagagtttttacattcgtcaggatgttgtgattgacatgctgctcaaattgacagaagacgtagcccagcacccgctccctgtcgtccacggccacaaaaatgggcgtattttcatcgtttattttctgactcaactgggtatccgtgtactttctgcccccggcccggaagagatccggccgcccggtgtgatgcacctgagccacctgagccaaaagttcatggatgcgggggatgtctctctcctctgctctgcgaataagcataggtacctccttcctaaccgccccagaggcgccccggcggagcggggacctctgtcctgtgttcaggagcaaatcataccacgttccgccccggctgacaaggccagagccccggctggcggtccttttcccgaacggaccggcccgggatcgcaaaattttgattgcctttaggcgcaaagtgccgtatgatggaggctggtgatgccttttgaaaaaattgcttcgggtactggggcggctgtttctggcgctcctgtttttagccgccgctgcgctggttaccctgggcctgctgcgctggcggggcctgatccttctgcccgacgaagcggaccccgacgagtgggaggtcttcggcgtggacgtgtcctcctaccagggggaggtggactggcccgtcctggcggagcagggggtggattttgcattcattaaggccacggagggctccctcctccaggacaggcggtttgccgccaactgggccgggtcggcggcggccggagtgcgggcgggagcctatcacttcctcagctatgacagcccaggcgagacccaggcggacaactttatcgctgcggttccggtgaccgagggggccttgcccccagtggtggatatcgagttctacggggaatatctggacacgccgccggagaaggagcgggtgcgggccattctggaccccctgctggagcggctggaggcccactacggcgtcaagcccatcctctacgtgacctaccgctcttactaccgctatatcgctgggggcggctacggggactatcccatctggtgctccagccccacggtgttcccgctggtgcccggatgggacttctggcagtactcccactccgccgagctggagggctactacgggacccagcggcgcattgatctgaacatcttccggggcagccaggcggaatttgagcggtttggatagaccggacggggacaggcgagaaaaaacgcctgtcctcttctatttccgccggaattctggtataataataaaccaatgtattttgtgtgtgggaggtcgctatggaccgatttgagagactggcgagtgccctgcggcggatacccggcctggaggtgcgggaaaacgagcccatgaagaggcacaccacgttccgcatcggcggcccggcccggctgatggcgttgcccaggagtcggaaggaggccgccgccgccgtgcgggccgccacagaggctggaatcgccccttttttcctgggaaacggcagcaatctgctggtggccgaccatggctatgagggctttgtgctcaaggcatgcggcctggatcaggtgcgtgaggtcaaccgccgtctgcgggcggagagcggtatcaccctggcccggctggccaacgctgccctgggccgggggctcaccggcctggagtttgcccacggtatccccggcacactgggcggggccgtggtgatgaacgccggggcctacggcggggagatggtgcaggtgctcactgccgtcacctacctggacggggcgggggaggagcacaccctgcccgccgccgcgtgcgccctgacctaccggcacagccggttctccgaccgcccggactggcttgtcctggaggcggagctggagcttcggccaggagatggagaggccatccgggcccgcatggacgaactggccgccaagcggcgggagaagcagcccctggagtggcccagcgggggcagtaccttcaagcggccggagggccacttcgccgccgcgctgatcgaggggtgcggcctcaagggcgtggggatcggtggagcccaggtgtcggaaaagcatgcgggcttcgtggtcaaccggggcggcgccacggcggacgatgtgcggcggctgatggcgctggttcaggagacggtgctgcgggagaccggcgtggcgctggagccggaggtccggctgctggggttctgacggggcgcggaaaaaggagattgcaatggaatttatcattatatccggcctgtccggtgcgggaaagagtaaggtggcctcctttctggaggatatcgggttctacgtggtggacaacatgcccgccccgctgatgcccaaatttgccgagctgtgcatggccgggccgggccgctatgaccgggtggccctggtcaccgatatccggggcggccagaccttcgatgggctgtttgacgccctccacgagctgcaccgcatgggctgtgcgtataaaatcctctttgtggaggccagcgtagagaccatcatcaagcgatacaaggagacccggcggatgcacccgctgtcctcgacctcccgctcgctggacgaggcggtgcggcaggagcgcaccgtcctggcccccgtccgccagcgggcggagtacatcattgacacctcggccctctccaccgccaagctgcggggggaggtgctgcggctgttcggggatggggggagtaccccggccatgagtgtcagcgtcatctccttcggcttcaagtacggcatccccatcgaggccgacctggtgttcgacgtgcgctttctgcccaacccctactacatcgccgagctgcgccatcagaccgggctggacgagggggtatacagctttgtctttggctatcagcagaccaaggactttatggcccacctggagagcctcatcggcttcctcctgccccagtatgtggaggagggaaaggcggcgctggtcatcggcatcggctgcaccggcgggcagcaccgctcggtggccattaccaaggccctggccgacttcatcaagcagaagggctatcaggccacggagaaccaccgggacatgacgcgggcgtgaggaggtggacactatgacggaatggaacggcggagcgggccccaggattgtggccatcggaggaggcacggggctgtccaccatgctgcgggggctgaaaagccgcacccgcagcctgacggccatcgtcaccgtggccgacgacggcggcggctcgggcatgctgcggcaggatctgggtatgccccctccgggggacatccgccactgcatggaggccctggccaacgccgagccgatgatgcagcagcttctgacctaccgattcccggagggctccggcaacctgacggggcagtccttcggcaacctgattctggccgccctcaacggcatctccgactccttcgaccaggcggtggcccgcatgagcgaggtgctggccatcagcggccgggtgctgcctgtgaccaatgagaacgtggcgctggaggccaccttcgagaacggcacccgggtgctgggggagtctaagatcagcgccttcaagaaggagcaggactgccgcattgagagcgtccgcctgctgcccgagcacccaaaggctctgccggaggcggtgcgggccatcggggaggcggagctgatcctcctgggccccggcagcctttacaccagcgtcatccccaacctgctggtggacggcattgccgacgcggtgcgtgcctccgacgcgctgaagatctacatctgcaacatcatgacccaggacggggagaccgagggcatgaccgcctctgaccacgtaaaggccctgctcgaccactccgggccggggctggtggatctgtgcctgtgcaactccgcgccggtgcgccccggcctggtggagcggtacagagaggaggacgccgcccccatcgtggtggaccgggcggccatcgaggccctgggggtggaggccgtcacccggcccctggcctccgagacccttaactacgcccgccactcctttgctcgcctggccgaggcggtgatggagctttacaatgagcgggccgacaccaagattttttgagaaagggaggggcactatgtcgttttcctctgaggtcaaggcggagctgtgccggacggccctctcccgccgctgctgcgcccaggcggaggcctatggagtgctgctctactgcaaccagttcaccgcctcacaggtgcgcatcagcaccgagtccaacgcctttgccgcccggctgcccgccctgttccacagggcctttcagctctcctttgaccgcacgccggaggagggggcggccaagcggattttctccatcacagagccggacaagctgtccgccctctggtcggcgttcggccatgagccggcgggcaccctggcccatcacattaactttgccgtgctggaggaggagcactgccgcctggccttttttcggggggcctttctggcgggcggctcggtgaccgacccggccaagcgctaccacctggagctgtccaccccccatctgagtgtcagccgggagctgcgggccctcctgctggagtgtggcttcacccccaaggagaccacccgcaaggccaactccatcacctacttcaagcagagcgaggccattgaggactttctcaccgccatcggcgcgcccctggcggccatggagatcatgaacgccaaggcggagaaggatctccgggggagcatcaaccgccgggtcaactgcgacgcggccaatctggacaaggcggtggacgccgcccaggggcagatcgaggccatctacaggctggaggagcgcggcatgctggaggagctgcccgacaagctcaaggaggcggtggatctgcgggtggcccacccggagctcaccctggcccagcttgcggagctgtgcgaaccgcccgtctccaaatccgcgttcaaccaccgcctgcgcaagctgatggagatggccagggcgtagggcgggaaagaaaagaaagggtagattgccatggagaagcaagtggttcaaaagcgctggaagctgattttctggggccttacggcggcggctgttgcgctgctggcgccgggcctggtgctgacgctggagccggcgctgtttctggggctgggcgttctggcggctgtggtattctgcacgggtctgtgtattgctgtgatcaagctccggtgtcctgcctgcggcggctcggtgtaccaccaggccatgcgggcgcaggagggcatcccctttgcctgcccaaagtgcggccggaagctggagatgaaatgagatgaaaaagagaggagacgcccgaaagaccaggcgggtgctgctactgcctacggtacccgcctttgcgccccgctgtcctctctgcggggccatactgaagataggtattgaccattgccactactgcggagccatgctcaccaaatagagaaagaggaggtactcctaatgtcctttgtccacctgcatgtccataccgaatattccctgctggacggggcctgccgcattcccctgctggtcaagcgggtgaaggagctgggccagagcgccgtggccatcaccgaccacggcgtcatgtacggcgtggtggacttctacaaggcgtgcaaggcggagggggtcaagcccatcatcggctgcgaggtgtatgtggccccccggaagcgcaccgacaaggtacacgagtacgacgcggccatgtaccacctgattctgctgtgccgcaacgaggtgggctaccgcaacctgtgcttcctggactcggcggcctttacggagggcttttatatcaggccccgcattgacaaggaactcttgcgccagcatgccgaggggctcatcgccctgtcggcctgccagtccggcgaggtgccccgcaagctgctggccggggactacgagggggccaaggcggcggcgctggagatgcgggcgctgtttggagaggacggctactatctggagctccaggatcacaagctgcccaacgacccggccatcaaccaggggctcatccgcatccaccaggagacgggcatccccctggtggtgaccaacgacgcccactatctccgccgggaggacgcggagatgcaggacaccctcatgtgcatccagatgggcaagacggtggacgatcccaaccgcctgcggatggagaccagcgagctgtatgtcaaatccaccgaggagatggccgctctgttccccgactacccggaggcggtggagaacacggtcaaaatcgcggagctgtgcaatatggacttccagttcggcgtccaccacctgcccgagttcaagctgcccgagggctacaccgacggggacgcctacttccagaagctgtgcgaggagggcttcgcgcgccgctaccccggcgccccggcggagtaccgggagcggctggcctacgagatggggattatccgccagatggggtttgtggattacttcctcatcgtctccgatttcatcggctatgccaaggggcggggcatccccgtgggccctggccggggctcggcggccggctccatggtggcctactgcatggccatcaccgacgtggacccgatgaaatactccctctactttgagcgattcctcaaccccgagcgggtcaccatgccggatattgacatcgacttctgcatccggcggcggcaggaggtcattgagtacgtccagaataaatacggtgccgaccacgtggcccagatcgtcaccttcggcaccatggccgcccggggcgccatccgggatgtgggccgggcgctgaacataccctatgccgacgtggatgtggtggcaaagcaggtgcccagcggcccgggtgcactccatatcaccctggacgaggccctcaagctgtccaagcccctccgggacgcctatgaaggggacgagcggatcaggaccctcatcgacaccgccaaggccattgaaggcatgccccgccacgcctccacccacgccgccggcgtggtcatcacccggaagccggtggtggactatgtgcccctggcgaagaacgatgagtcggtggtcacccagtacgtcatgaccaccctggaggagctgggcctcttaaagatggacttcctgggcctgcgcaacctgaccatcctggacgacacggtgcgcctggtgcagaagagccgccccagcttctctctggcagacatcccggacaacgacccggcggtgttccagatgctctccgagggcaggacctccggcgtgttccagatggagtcggcgggcatgaccggcgtctgcgtgggcctcaagccccagaacatcgaggatatcaccgccatcatcgccctctaccgccccggccccatggactccattccccgcttcatcgcctgcaagcacaacccggacaaggtgaagtacaagcaccccatgctggagcccatcctctccgtcacctacggctgcatcgtctaccaggagcaggtcatcgagattttccgcaggctggcgggctacacgctgggacaggccgacatggtgcgccgggccatgagcaagaagaaggtcaaggacatcgagcgggagcggcaggccttcgtctacggcgacgccgggcgggccattgccggctgcatcgccaacggcgtcccggaggacgtggcaaaggacatctatgatgaaatttacgcctttgccaattacgccttcaacaaggcccacgcggtggcctacgccattgtgtgctaccagacggcctggttcaagtgccactacaccaaggagtatatggccgccctgctcacctccgtgctggactccagcgagaaggtggctgagtatatcgccgagtgcagggactgcggcatccatctgctgccccccgacatcaatgagtcggaggccgacttcaccgtgtccggcgagcacatccgcttcggcctggtggccgtcaagggagtgggccggggctttatcaacgctgtgctggctgagcggggcaggggagggccctttgtctccttccctgatttctgccagcggatgttcgacgcggagctgaacaagcgtgtgctggagaatctgatccgctgcggcgcctttgacagtatgggtatctaccgctcccggttactggaggcttacgagcagctagtggactccatcgcccagaacaagcgcaagaacctggcgggccagttcgatctgttcggcggcggtggggatcagatgcagagcgccccggagctccaggtcaaaaatatccctgagtttacccggcacgagctcatgaccatggaaaaggagacgactggactctacctcaccggccaccccatggacgaataccgggacgtggtcaagcagtgcaaggcggcctctatgggggcgatcctgtcggacttcgcccaggaggggggaccggccatttaccacgacgagcagcgggtcaccctggcgggggtcatcaccgcctcccgcaccaagaccacccgcaacaacagcctgatggcctatgtgacgctggaggacgacaccgcctccatggagatgcttgtgttcgcacgggtgctgggggaggcaggcccctacctgaaggagggggtggccgtcctggccgagggacgcatctccgttcgggatgaaaaggcgccccagctcatgtgcgaccgggtacgccccttggatcaggtgaagggaaacctgcctccggtggagggggaggagagggccaagaagctctatatccgcatacccagcctggacgacccccgctgggagaggatcaagctggtgctcaccatgtttcccggcacggaacagatggtggtcaagtgtgaggataccggaaagcggctgggcacggtctgcctggtccatcccgcgctgatccaggagctgaacgagctgctgggcgcggagaatgtggtcgtgcggagaggggagccgatgagatgaatattaaaaaactggcctccctgctctttcagcggtcggtgatcgtggccctgctgatcttcctccaggctgcgatgctgctgctctatatgctctggttttccagcgacttcatttatgtgtactgggggtgtgtggtgctctccattctggcggtgctgattatcgtcagccgccagaccgacccggggtataaaatcgcctggatcatccccattctgctgttcccggcctttggatggctggtgtatctgctctgcggcggcaacaagctctccgcccgcaagcgccggaagatgcagggtatggaccgcaccatgctggagcagttggagcgggactacaaggcggaggagctgaggccctttggggccgacgcggtgaaccaggcccgctacctggagcactacgcccgctgcccggtctataccaacacctatacccactattttcccctgggggatgatgtgtttcccgccatgctggaggagctgcggaaggcggaaaagtatatcttcctggaatacttcattattagccccggcatattctgggattctatggtggagattttgaaggagaagcatgccgccggggtggatgtgcgggtgatctacgacgatgtgggctccctgaacaccctgcctatgaactacgccagaaaatttgagacggaaaccggcatcccctgctgctgcttcaaccgcttcaagccggtgatttccatccgcatgaacaaccgggaccaccggaagttctgtatcatcgacggccacaccgcctttaccggcggcatcaacctggccgacgagtatatcaaccaaaagctgcggtatggccactggaaagacacggccattctcctcaagggggaggcggtgtggagcatgaccgtcatgttcctgaccatgtgggagtacacccgggacgtggaggaggactaccgccgcttccggccggacaagctgccgccggaggccgcgcagggagcggggtactatgtccagccctacgcggataaccctctggacgaggaggcggtgggggaggcggtctacctcaaccttatcaacaaggccgagcgctatgtgtacgccatgacgccctatctgatcatcagtgacagcgtcaatacggccctgtgcaacgcggccaagtcgggggtggacgtgcgcatcatcaccccgcatatcccggacaaggcattggtttttgagctaacccgttcccactacgagtccctgttggaggcgggcgtgcagatttttgagtatacgcccggctttgtccatgccaaggtcatggtcacggacgactgctgcggagtggtaggctctatcaatctggactaccgcagtatgttcctccactttgaggacgcggtactgctctaccacgaccccacggtactcgacatcaagcgggatttcatcaacacgcagttccgcagccagccggtgacgctggagcagtgcctcggccactcctggatacgccgcctcttccgctccattctgcgggtgctggccccgctgctgtgacaaaataaggccgcccccacagggggcggccttattccgcttcaatccttctcctcgtgttccagcagtgcggagagaacctcattgtaaatccgctccggctcggccttgaagctctccgccaggcggttggcctgctcctgggagccgcagaacagctccagggtgaacagattgcccccgtcatcgtccagaaacatccgggctgagtacccgccctccggccggggctccgtctccgcacgtacttgagcattgcgccgcagaatcccgttgagttttaccaactgggcgctacagttgcgcttgaccgagtaggggaggctgctctcacaggctgcgccgttttcccggcctttttccgtgatcgaatagagcccgtcctccagtgtcagatggccgctctccaccaattcagaaaccgcctcggcaaactcaaagtagccaatgccgtcatcgcagaccgtcagctccgtcagtgtcggaaagtcgatgggcgccgcgacccgggccataaaatagaggatcaaaaatttaatgtccagcttgtcgtggataaagccgtagcgagccatctgggaactcctttccaatagacgagtcaaacataatatgtatttatttattataccgaaaggttgagaaaatcacaagaggtatttttgacttgacgctggtctaaaaatatggtattatcctatactgtcggtaacaaatatatgctggaatagctcagtcggtagagcagctgattcgtaatcagcaggtcgcgtgttcaagtcacgtttccagctccagaaaccggcggaaatcggatgatttccgccggtttcgtcactttttgagggaatacggtgggagtaaacgtgtggtctgaccgccgacccacaccgtgacccacatgccgaaacaaccggaaagggccggagaggatttttgtcctctccggccctttctgttcctcggtgttacagcacctgcgccatgaaattccccatcttttctgcagccttctcctgcatccgccggttggtgtgggtgtaggtgcgcagggtgaacccggcgtcgtagtgccccaacatggcggataccgttttcacatccacgccgctctgtagcgccaccgtggcaaaagtgtgcctcagatcgtgaaatctgatgtattccagcccggcgtccttcaggatcttcttgtggaggttcacgatggagtccgggtgatacatgccgccggtcctgggggatgggaacagatagtggctctccgggtgccgctggtgctcctgcaccagcagttccaccgcctcccggggaatggagatctcccggacggagttggacgtcttgggctggcaaatggccagctctccctgggcgttccgtcccacctgcttgctcaccaagatggtgccgtgctccgcatctaggtcagtccagagaagggcggccagctcgcccttccggatgccgctgaccagctccaggtagaacagggccagcacgccccgccgctccgccgcctccaggtaggccctcatgtcctccggcttcagggttctcatctcctgcctctggagcttgggcacgacacagtcctcggccgggttgtggagaagcagcttttccttcaccgcccggtccagggcgctgtggagcatggtgtggacgccccggatggtggagctgctcagaccagggcgcttggacttctgcacggctctgcggcggccgttctgctgcagctcccggtacaggttctgaatctgccgggtggtcagctggttgagcttgacctccccgatgtaggggatggtatgcagctcgatgccccgccggtagtactccgccgtggagaaccgcaggttgggtttggcgtagacctcaaaccacagcctcagccactcggccaccgtgtattttccagccctggccacgtccaggctgccggcctccccaatggcctgcttcagcttcgccttgacctcggcctgggttctgcccagtacgttcttgatgatccgcttgccggtatccgggtggtatccggcggtgtaccggccctcccagcggccatcgctgcgcttgcgaatatttccctcaccattggcccgctttttggccatgttgttcgcctcccttgcagcaacacaacatactccagaaaagagaaaatatccagggcaaaccagcagagttaacagatccttatcatttggccgcacccggacctctctttgtcaacggcatcgcatttatgccggaggaaagaggtttctctttgttttgcggcgcaaattttgcattctcagtccacggcgtcggtcaaaaaggccggaaccggctgggaacactgactttctccagatcactgcccaactcaatttaccggctatgctgaaaaagccgaaaaccccaattagtagcggctatttcaatacaaagacccttggaattatgtgtgttcggcaacccaattctgaacatgctccagaaaacgggagactgctggtgacggaataccattggagcgaaccgccagagcaatatcccggtattggggaggatccaagggcatgtggacgatgtgataaggcatccggttcaggatcagttcgctcatgattccgacacccagtccgcattcgatcatagatgcaatgatattgctgtcctcagcaaagtagcggatattggggcgaacaccacaggacttaaaaatgcggctcatatcccgatcctgatcctcacggatgggaataaagggatcctcggaaaagcgggtgactgggtaggacttggcccgggccaacagatgatccgggggaagcaccgcgcagagctgttcccgcttgagaaagaaggtgtgcagcggcggggtggaacgcacattcagcggcagggtgacaaagccgcagtccaccccaccctggatgatgctgttctcgatggcactatactccagattataggagatctggatgtctacattcgggtagatctggagaaaagagcgaacaatttggggaagccagttggcagccacgctgtgaaagcttccaacccgtactgtaccgccatccagggacaagagccgctctacagagccctccaactctcgctgagcagcgcagaccgcacggatttgggggatcagatattctccctccggtgtcagggacacacctgtccgattccgaatgaggagaggaacaccccactcccgctctaaatcggcgatgactcggctgaccgccggctgggtataacccagcacatcggcggcctgcgtgatgttgcccagttctacagttttcaaaaaggcctcatattttgacaattccaaaatgtctcaccagccatgaaaatttcgtatggaagcgatagagatgtttaatttgtcaaaccagtggctaaatcgtacaatagcgatgtaaaaaagtcaagagctcatggcgaaaacgacaggaggaagagaatgcatgaaagaaaccattgcgcaaagtgtggccgaggtgcaggaacatgtggtagcgcaccgaaggacgctgcaccagattccggaagtcggtctggatctgccacaaaccgcgggctatgtccgaaagattctgacggagctaggttgcatcccccaaaatattggaacctgcggccaagttgtgacgctgggccagggagagcgcaccctgcttctgcgggcagatatggacgcacttcaggtagaggaacacaacgacctgccgttctgcgctgcaaacgggtgcatgcacgcctgcgggcacgacatgcatacggccattcttctgggagccgccgaggtgctgaagcggcatgagcaggaactcccctgccgggtgaagctggtgtttcagccgggagaagagctgggtacgggcgcccagtccctggtagaggcgggacttctggaaaatcctcacgtggatgccgccgccgcgctccacgtggactccactatggcggtgggtgagtgttcctactgtaccggtgtggccacatcagatatttacgacatctttatccagctcaaggggaaggggggacacagctcccagccggaagagacaatcaatgccctggcagcggccaacggggtgtttcaggcactcagcgggctggtacagcgggaggtgagcggatttgatactgccattctagctatctgctccatgcacgcaggcagtcagcagaatcccaatatcatcccggaaatctgcgagatggccggtacccttcgttgctttgaccgggcgctgggccagcgtctggtggagcgcatccgcgagattgttgagagagaggcggcctgttaccgggcggaaggcacggtggagaccctgctcaccccgtcgcttactgtggatccctccttggcagagcagttggttccggcccttcaggaagtttttggggcggagcatgtggtacgctccacccggcctttcgcgggcagtgaggatttttcttacatcgcacaacaggttcctgcattcttttgctggatcggcgcaggaaagccaggtaatcccatgcttcataatcccaatatcatcttcgatgagcaggcgctggaatacggagtgaaagccatggtgactctaccttttgtgtgggccggccaaacctccatgtgaacggataccagagaaaggagccattccaatgagactggataagaaaaagagaggctttcagctgcctcacgtgatcattatcctgatgtgcatcatgctggcagtcacagtaatgtcctttctgatccccagcggggagtttgttcgagatgccaacggtgcggtagacccgacccagttcagctatgtggaaaatgacaatcccatcactttctttgacttcttctatgacatcccccacggcattgtggagtcagcggacattatcatctcgattatggtcatctccggtgtgctctatgtcatcgagcagaccggagccatttccgccgccctccagcggctcactgctgcggccaggggcaaggaggtctttgtggttctgggcctgacccttgtcttcggtgtgctgggggttatcggctggggggaggacgcacttcccttcgtgcctatggtggtcagtctggccttggccttggggtatgatcgggttgtaggagtagccatcgtacagttgggtgtctgcatcggtttcagtacaggcgccttcaacacctttacgaccggaatctgtcaggagcttgccggcgtccctattttcaccgcctggcagttccgcctaatggagtttgtcatctgttatctgatcctggcgcttttcctggccagctactgccggaagatcaagcgagatccaaaccggagcgtgatgcctgagttccagagaggtgagcgacaggagcagaaactcatgacagagcaggttcccatgactccccgccgggtgctcactctgctggcctttgtggtcgctctcatcgtacaggtctttggagccatccagttgggttggggaatggaacagttcagcggcctgtatgtgattctggcagtggctgtggcggtgatcaatggtatcagccccagcaaggcctgcaccgacttcatccagggtaccaccaccgtcatgtcggcggtgatcgtcatcggtgttgcccgggccatctacctgctgatggatcaggccaaaattgtggacaccattatccacgcgctcgccaacgtctttgaggggaaaagcccctttgtggtgcttctgctgctctatatcttcgtcatcgtcttcaacttctttgtcacatcggccagcggcaaggcgtttattctcttccccatgctcaagcccctggcagatattcttggaatcaaccagcaggtggtggtcaccaccttccagctgggtgacggctttaccaactggttcttccccagctccggtctgctgatggccgggttggagctgggcggagtcacctatcagcagtgggtgaagtttgccgccaagatcatcggggcactggtgctggccggactatgtttcgccttcctagcacagatgattggcctgtcttgagcatcacgggcagaaaaaaatagaataaacacgggtccggctcttattagatgccgggcccgtgccattttgatcgaactgtttgtgtttctctcatattgaatactgctttctatgttttgcgctcttgatccacagcggcggtcaaaaaggccggaaccggctgggaacactgcctttctcaaaaccaccgaccacccaaaactccgaagtccgtcctcagcgaccacctaagtttcctctggggcgaaaccccgtaaccccttgacacgccccgcactgcggggcgttgtaaccgggccgtcggcggtttaccgccgcggtcctttatcctagtacgaaaatcgaacgcccctaaagggcccaaaaccgggctccctggaggtactctttctctgaaattttatgtgggaatgctgcttagatcggcgcatcctgtgggtctaccctactcccctcccgaaagcggcacacagggctgacacggccgcgacaggggccttcctgtggtcgtccggctttccttccggagtgggtgcgggctacgcccgcaaatgtgccaggctgccgcttgcggcaagccaggtgctctgcttgccccacccaacggtgggtaatatggtacttttccggatgggaactttgttaacacgtttagagaccgagcgggagaatactccgttttacatgcaatcccaatactgtccagccactcccttcaaaatctatgtcttctattttcccactgcaatcgaagccacttaaatcagctttgggattcagcgcattgatggtttattgaagtcatgcaagcggaaaatcgccagttaggtgatgtctgtcctaagttaaattgtataaaacagaaaaagtttagatgcttttttgttcactattcagggaaaaagtcgaatttgcgtcgttttttagacaattcggcaaacctataatatagacatcccaagcaagaggccgtaaaacactgtagaaatgtgggaggtaattgtatgaatgtggaggcaatgacaaacaacttgggactttggattatatgcagcgtcatggttatcgtcattctggtccaaagcatcctgtatttccgcctgggacgcgccgaagcaaaaaagctgcaaatcccgaaagagaaggtgacccacggcattcgcgccgcggtgatcacagcgattggcccaacaatttcctcggcgatcgtgctcttgtctctcgtggttatgatcggtggcccaatggcgtggatgcgcctgaacgacgtaggcgcggcacgaacagagatggcgattgtatctatggtgcaggcgatcttgccggaaaattcttctgatgtaaccacaatgacattcgcagcttgggggcaggcgtttaataacgtcgggtggatgattgttgctttggtggcgaccagccggatgggctgggccgtggagaagatgaaccagaagttcagccccgtgattgtgaaggctgcgatgtccggcgcggcaatcggcctgtttgcctacctggtttccaataatctgattggaaagcccagcccgaattgggttgcggcggtcgttgcaggggcgtctattctggtgatcaacaaggtcttttctcgtatgcaacgcctgcaggagttctcactgggtattgccatgatcctgggaatggtcgcggcgacggtcgtggaaaatgtcgccggtatctgagataggggtgaatcaaaatggatggatttaacagaaaagtcgtaaaaataggtaccattacggtgctgtgcgcaatcgtcgcaaactttctcccggtgctgtacctctggattgtctatggggagattcccaccggctcccagcttgccagcatcctcagcatgattttcgcggcctcggccgtgagctggattgtacagccactgtcctattatggcggtctgggcatggttggcacctatatttcgtggatttccggctccgccgccgacatccggctgccgtccatcaacatggcccagaaggtgaccaatacggaggcgaacaccccggagggagacgcaatcggcgctatggctctatctgcctccgtattcaccacagtcggaatcatcagtgtgtttgctgtggtggggagcagaatcatcccgcttcttccagaagtcattacccagtcgtttacctatatgcagccggcactcttcgccgctgtctttgtcaatatggcggtgaaaaacctgaagcccggctttacgacattggcccttggcctgctctgctgctttgcgctgccgcagctgggactgtccacggcatggcttacgctgattgtcgtggtcggcgggcttgtcatcggcatcctctttgcacgcaaaggtgcccggaaaaccgctcccggcagcaaataattttccataggagatccaaatgatctaaagagaaagcgggaggtgtatcttccatggagatgtcgattttcatggatacacgatctggtatgaaccgcccccggctccggagcccaatggaatgcccggacgccttggacaagctaactggaggagagattgccatcctctcggaggcgcgtgaaatcccgggcatcacgcggatctggcaatgagcgcgggacggccacagaatggccgtaaacggcaggccgtggccggtattgccgtggtggcagcggcctgcctgctcctctggctgggcggcgacgcacttgccttgacgcaggaggcaaggatcgccctgctggttctggtgggtgcctgcgtgctgtttttcacagagctgattccgctgggcgtgtcggccctgctgattccggtagtgctgtgcctcactggcgtgctgaccgaggcggaggcctttgcatccctctgtgacgacaccatcctcatgttcgcgggcatgtttgtggtgggacaggccatgtttgccatcggggtggcccaccggctgggcgcgtggatcgcccgctggtccggcggacggcctctggccctgatcttgggcatgggcgtggtcacggtgctgctctcctctgtgctgagcaacaccggcacggtggccgtgctgctgcccatctgcctgggggtggcagagagctccggcgtatcgaagaagtggctgctgtttaccctggccaacgccagcggcataggcgggatgattaccatggcgggcacgccgcccaacgccacggtccactccgtcctggtacaggcgggggaggcgggcttcggctttgtggagttcgcctggctgggcattccggtcagcgcggtcgggctgctgtacctgatttccccgttctgccggaagctgctgggcgtgccgcggcaggtgatgctctcgcccgcagccgggcgcactgcgggtagccggactccggaggaccggggcgcggagcgctccgccggacggcaggccctctccatggcggtgctggtgggcgtggtcatcatcatggccaccggctggattcccctggggctggcggcggtggccggcgctctgctgtgcgtcatcgtcggtctgctctccgccagggaggccatcagggccattgactggtccaccattttcctgttcgccggcaccctggcgctggcggaggcgctggagaccaccggcgtaggccatctgattgccggcctggtggtcgccctgtgcggcggagagatcaactactatctgctcattacggtgctgttcctgttctgcggcttgatcacacagtttatgtccaatacagcagcctgtgccctgctggctcccatcggcctgcagatcgcgcaggggctgggggttgcccccaagagcgtgctgatcgtggttgcggccgcggcgtgcagctcctatctgacgcccatggccacgccgcccaacacccttgtattcggctgcggcggcttccggttccaggatttcctgaaggcgggaatgcccctcttcctgcttacctaccttctgtgtatcctgatcgtcccggccgtgtggcccatctagcgggaagggcctgtttcaatacacagcatcccgcatgtttcccatttgaagtcagcaaaaggaaaggaaaagagatcatgtttgatatcaaaattataaatggaatggtgatcgacggaattggcgatacccggtacagggcggacattggcatcacgggcgaccagattaccgccattgggaatctggctgacgcgccggccctggaaaccgttgacgcccgggggcagattgtctgccccggctttgtggatgtacacacacattccgacatgtgcctcatgtatgatcacctggggagcagcaagatctatgacggggtcaccaccgaggtgatcggaaactgcggcatcggcgtggcgccagtatcggacgataaaaaggagcagctgattacctatctcaatacacggctgattggttccctcccggtcaagctggagctcccctggaataccatggacgaatatctgacggcgctccaggcgtgcagtcccgcaaccaatgtggtgcctctggtctcccacggcgccatccggatcaatgagatgggctttgcgcgcggacggcccacagaggagcagctgtcgagaatgcggcatgaggtgaagaaggccatgcagacaggatgctttgggctgtccagcggcctgatgtacatgcctggagagtacagtgacgtggacgagcttggcgcgctctccgcagaggtctccccatatgacagtttttatgtctcccatatccgcagcgaaggggaatccattatggaggccctggacgaggcgatcgccatcgccaaaaagggcaataccgcgctccatgtatcccacctgaagctggcgggttccactgtgtgggggaaaacggacgaggtctttgaaaagatctacagggcgagggcccagggccttgatgtgacctttgatgtctatccctacgcgtgcggctgcacctccctgggtacctgtatgccgccctggacctttgagggcggcaccgcgcagatgctggaacggatcaaggaccgggccaaccgggaacggattgtccgcgaaatcaaggagggcattcacggctggcagaaccccattaaaacggtcggcgattggaatcggattaccctcgccacctgctacaccaaggagggtgaagccctcctgggtcggacaatcgcggacatctgccaagagacccaccaggatccctttgaatttatcttcgattttctgattcaggagaacggccgggttcagatacttgcggccatgatcgaccaaaacgatctggatacgattatcgcccatcccgatgcgatgatcggttccgacggcatgaacctgtccaccgtcggcgtcctctccgcagggcatccccatccgcgcacctttggaacccacggccatgtactggccgactatgtccggacccgcaagattataacgctggaggacgccgtcaaaaagatgacctccaaacccgcccagcggatgcgtttggagcggagagggactctccaggaggggaactatgccgatgtcacggtttttgatcctgacaccgtccaggacaaggccacctatacagaaccgaaacagtacacacaaggtatcagcacggtgattgtcaatggacagtttgcgctccgcagcggggtgcagacggggattacctccgggcgggtgctgcgtaaaaataacccctaagttctggagcgggatgggcgcgcggccggcgtgtcccattccgctctgcggaatcccgcaaaatcgctgttcaaggagaaaatcatgggtaatcgcactataggaatcaatccatatctggtggactatgttcccaaagactacgcagggaatatgccggagggcgaggtcaaagtggactgctccctgggcgtaaacgcatctctgctggggaactgcatctttgagaggcttcatcaatttcagcagaaaaaggtcctgtatgtcgggaactgcgagcaggtgctctgtgaggggagcttcaatgaaatcaaatattacccccatgacgagacactgaaggacgccttggccgactggtatcgaaagcacggcgtgggtacgggatggctcaccggggagcacttcatctgcggcaacggctcttacgatattttatgtaatatcaatctgctctgccttacaggtgggaaaaaggtattgggccacgcgccgcagtttacggcctatgtggaccatgtaaactgctccggctctctgtatcaggcctattacatgaaaaaggactgcaattatcggtttcagccccgcgagtatatcgcgcagatgtcagaggatgacgacctgtttattgtagaaaatcccaataacccaaccggccagatcatccccatagacgatatcaaagcgatcgcggacagggcgcagtctctgggcaaaattttggtcgtggatgaggcttacggggaatatatggcgttttccaacagcgcggtcaatttaattccggagtaccccaatgtcatcgtaacgaggaccttttcaaaggggtggggcatggccggaatccgcttgggctacgcggtcggaagcatagaaaacaacctgctcccctgcctgaaaaaattggtcttgccatttaacagcaacgcgattgcaaaggcgctggcgttgacggcactgcgaagcaagctggaaaacgagcgggatccctttgatacggatacagtgtttacaaataagcggctactcatggatacgatcatgcaggcggataagcatggaacgcccagaatggcgattgctcagaccgcaagcagcacgccgatcatgacgctctattacaccggtaaggaagcgcattttgatctgcaggcgcatctgatcaaatttggaatcctggccgtaagctgcaaaacctatatgggcctgaatgaacgcgccgtgcgccttatgcttccccagagcggggagatgccggtgcttttagaggcgatggaaaaagcaatccaggcgcttccagaataggctgcagaaatggcgtcccactgcggtgggatgccattgttttacactggacaaccggacgcatctgaaatataataagcaaaaacagatagattggtggggatattatgctgaaatttttgttcgtcctgcccctcagcttcaaagagattgaggggaaaatcagggagctgatctatcgggaattttcgtatatccaagatgaatacttgatttatgatacctacgaaagcgcggtggcgcagcttgcagacaaccagcagacatatgacagcatcttttttgccgggccttatatctacaattatatgatttcgcggctgcgccagctgaatcattggagcgtattcccgagatcaagcaacaccatgctgcgggcgatttccaaagctgctttgtccggctgggatatcctgcgtctttccatcgatacctacagcaagcacgcagttgcggaagcctatcaggagctgtccatccgggaggatacgcttgcgctgccggtctacaatgatatggacgacatggactttacgcagaacgccctgcaataccatctggagaacctgaaggccgggaaggccagcggcattataaccgtctcctccggtgtcgtctccgaactggaaaaacggcggatcccatatatcgcggctgttccgacgctcgataccatacgggaaacgctctttaacaccgttcagtaccaccgggcccagaaaaatatcctgggccagattgccgttatttatatcaacattaactttccgccggagcactctctccttttaagcgacgagtacagctttatgctggaaaagatgaaaataataaaagaggtctataaatatgccgaccgcctttcagcctccgtggcggaggaatccatttacaattttatcctgttttccacctatggggcgcttgacctggagacagctcacttccgaaagttcgagctgctcaattggctggagcgtgtaacctgctattctgtttccatcggccttgggaatggggagacggcgattgatgcgcgccataacgccttccgggccatgcttagagcaaaaaatcacgagcaaaatgccgcatatgtcctgatcaacgggcaggagccgatgggtccctatctcggcgatacggtacagaaacagccggaggatcttcccgaagaattccaacggatcatgtcaaaaaccaatatcagcagcaataccatacaccgcctttatacatgggtattaaaagagaatattgatttttttacgtcgaaagaattggcagatggcctaaaaatgagcaaaagaagtgcagatcgtttaattgaaaaattattgtctgcagatttggccgtattaagtacagagcagataaaaggggagcgtggaaggccaacccgcattattcgattgaatctacccaaatttgaaagctaagacacaatagctcagattatctatcattcaatcaggtatcattttatcatctttttctaacaagtactttactttgaaataggctctggctgacccacaccgtgacccacacggaagacggagcggatggaaacaacggagagaaccgtgccaaagcagacacggctttggactaaacaggccgcaaaagcgcccaacggagctagtttgttgttcctaatacgcttcgtaatcagcaggtcgcgtgttcaagtcacgtttccagctccataaagccacaccaatctggatattttaagcgggacgcttagagtatcagagggtgcggcttttttattttcctgaaatttgtgttctaaaaaagatattttcgaggtattccggggcctcggagggaccttcccctggcttgccccagtttccgagcccccaacaggaatcagcgccctatttgaacacagtcagggcacaaaaatccgaaaaaatgatatacaaaaattagtgcgccggtttgttggtttcgtcaaccagcaggccggcgctttttttctgcccggcgaattcaaaaagggcacacacttttatgtccgctttgctgaatagctttttcgtggataagatggcatgatggcgttcacaagcagcagctcaggagcggccattgaaaaagggcgttttgcacggaaaaggaggtaaaagcgcatgaccaaagaaacctattttgaggagctgtcctgcgccctgcggcggcgggagctgctaccccggccggtggaggaggacggcctgctcccagcggagtggaacggccgcgccctgtgccgggtcacggagcgcggtgctgcccggtatgaccccaactaggtggacacagacggggcaaaggccaccctggcctaggtcacggaggcggcggggacgataatgaagtacatgaagctcctggagacggccccgccgctgaaggcggagagcctggcagacggctaccgggtgctggcagaattcaacggtacggtactggccgggaaaaagaccctgctgggggctcaattcgtcacctgggcctgggactatgaccggagaggcgtcagcaacggccactactacatggaggactaccaaaccgccaaggaggacttcaccttccgctccgggctgatggccagggagcaggtttttgaccgggagcggttggaggagctgcgccaggcggcacagggcttcctatgcggcgagggccccgcctcctatcggcaggaattccggtgccaacgcattctggaccagatccgatccccagttacccgaaccgaagcaaaatcaactacaaaaagagggaccaagcattgaacagtctatgtgaaggcggcgccgacaaaggcgccgccttttactatgcccggcatttatttgcctcctgtacccacaagctgtacgccccggatcatccggcggacgctccgcctgtgccggtgtgcacccgctcagacctgtgccggggctgcccctacccagcccatggcttcctctgctggagcaccgccggggaatgcctgcggactaggatgaaaaaaatccatacgggagggaaaacggatgatgcacgcagtcctgagtaattcgcggcacccggagtacggccagctcacagtcccttttcccatcccccggggcgcctatgacgacacggtggcagccctggcctctttgggtatcggtgacccggtcggccgggactgccgggtggatgagctcaacagcagttttctcatcctgaagcggctggagaaggtagcggtcaacgtggacgagctggactatctggccaagcggctggacagctctgacatcaatgaagccgccaaattccaggcgatgacagtgaaatggggcctgttcgagatgactgacctaatcaacctgaccttctggtgtcagcaggccaggatcatcacagacttttccgatttggaggacattggccgccggcactatatgcccctgaacggcgggagctgcagcactgaggagctggaacggctggatgcccgcaaggcggcgctggatctgatcctcaacagtgaaagcacctgcgtcaccccctgcggcgtggtctatgacaacgacatgaagctggaacaccactacgatggccagcacttcccatgctatctctgtcagcctgccatgctggtggtgggtattttcccgaagaatgcgccggagggatcaagcgagaccacatggctgaccctgccctgttctgagcagtagctcaagcgcggcatacagcagtccggcctggacttgggcacggccaacatccggtatgaggctgtcatgcttccctgggaggtgacgcaggtgctggccccggaaagggaaagtcccgttgccctgaatatggtcattgcccaggacaccgagtatgtcctgctggacgagcccaccaacgacctggacatccaccacgccgccaatctcatgaagaccgtccggcggctgtgcgacgagctgagcaagacggtaatcctggttctccacgagatcaactaggccgccttctactccgactacatctgcgctcttcaggacggcagggtcgccaagttcggcactgtggaggaggtaatgaccaaagaaaccctgtcggagctctaccaggtggacttcaagatcatgaccatcgcgggccggcctctgtccatctactattgaagcctccgagttttcagtacttttgtcgaaaaagaggccggcctggaggccgtcatggcctgtggccccgacgtgatcttcattgggggctggctggccggcagctacgacgccctcagccagatcgccccggtggtctatctggccaccgacagtgacctgggtgtggtggagagcgtacggcagaacaccagggccatcgcctccctgttcggcctggaggacacggccggagaactcatgaccggctttgacagccgcgtggcggccctggcctccttttccgaaggccgaaccgccattgtgtgggcctggttaccagcggcggcttcaatgtgctgggcaacgacggccgctgctccctcatcggccgggaagcgggctttgccaacgtgggggcggacgcccagcccggcacctccacccacggcaacgaggccagcttcgagttcctcgtggacaaggaccccgactatctctttgttctggaccgggatgccgccattggcaccgacggggccaagctggcccaggaagtggtggagaacgagctgatgaagggcaccgccgcctaccgggacggcaggatcgtctacctggcccatcccgccgtgtggtacaccgccgagggcggcatcaccgcgctggaccggatgctccgggatcttgaggatcccctgctgaagtaaataccgcagagcggaccgggatgagcgccgctcatcccggtccgctgccgttccgcctgcggaatgcttccggctcctgttccgtctgtttgaattggctatttattcactatactattcttataacgaatatataaaaattattaactgttataactccgatattatgaatatttatacagaatgactattgcgtttttatacgggttggattatactgggaacacatcagctgggcggccggcctcgccgccccacaggaggtcatcaacatgtctgagatcaagaaagtcgtcctggcctactccggcggtctggatacgtccattatcatcccctggctgaaggagaactacaacgaccccgagatcatcgccgtctccggcgacgtgggacagggggccgagctggacggcctggaggagaaggccatcaagaccggtgcgtccaagctgtacgtcgaggacctgaccgaccagatggtggacgaggtcatcatcccctccatgatgatgggggccaagtacgaggactatctgctgggcaccgcctttgcccggcccatcatcgccaagcggctggtggagatcgccaagcaggagggtgccgacgccatctgccacggctgcaccggaaagggtaacgatcaggtccgcttcgaactggccatcaagcgctttgcccccgaaataaagatcattgccccctggcgggagtgggacatcaagagccgggacgaggaggtcgactacgccgaggcccacaacgtccccctgaagatcagccgggagaccagctactccaaggacaagaacctgtggcacctgtcccacgagggcctggacctggaggaccccgccaacgagccccagtacgacaagcccggcttcctggagatgggggtctcccccgccatggcccccgacgcccccgcctatgtcaccatcgactttgagaagggctggcccgcggccgtggacggagtgaagatgaaggccagcgacctcatccgcaggctcaacgagctgggcggcgccaacggcatcggcctgctggacatcgtggagaaccggctggtaggcatgaaggaccggggcgtgtacgagacccccggcggcaccatcctctaccgggcccacgaggtgctggagcagatcaccctggacaaggacaccaagcacatgaagcagaagctggcggtagacttcgccgacctggtctacaacggcaagtggttcacccccctgcgggaggccctcaccgccttcgccacggacactcagaagtacgtcaccggcaccgtgaagctcaagctctacaagggcaaccttatcaccgcctccatctcatccccctgcaccctgtactccgaggatctggtcaccttcggggagagcgactacgaccagacggactcccagggctttatcaacctgtggggcctgcccgacaaggtccaggccctgcgggagcagggaaagctctgagcggagaccctgtctgatatctttttccgcctgcggacggcaaaactccgcgaggcaaaaggagcgatactatgaaactgtgggccggacggttccaaaaggagacggatgccctggtcaacgacttcaactcctccatttcctttgacgcccggatgtaccgggaggacatcaccgggtccatcgcccacgcggccatgctgggcaggcaggggatcatcaaggagcacgaggccgagaagatcattgacggcctcaaggccatcctggccgacattgaggccggacaggtggagttctccctggagaacgaggatatccacatgaatatcgagaccatcctcacccaacgcatcggggacacgggcaagcggctgcacaccgcccgcagccggaacgatcaggtggcggtggacttccggatgtatgtccgcaaggagatccaggccatcatcggcctgatcctggacctggagaaggtgctggtcaggaaggccgaggccaatctggacacggtcatgcccggctacacccacctccagcgggcccagcccaccaccttcgcccacgccatgatggcctacgccaacatgttcaagcgggacgtgacaaggctggaggactgtctggcgcggatggacgagtgccccctgggggcgggggccctggctacctccacctacccggtagaccggttccagaccgcacaggctctgggcttttccaagcccaccgacaactcgctggactcggtgtccgatcgggatttcgccctggagtttctctcggcctgctccattctgatgatgcacctgtcccggttctccgaggagatcattctatggtgctcctgggaattcaagttcgtggagctggacgacgcctactccaccggctcgtccatcatgccccagaagaagaaccccgatgtggccgagctgctgcggggcaagacggggcgggtgtacggctccctcatcaccctgctcaccgtcatgaaggggctccccctggcctacaacaaggacatgcaggaggacaaggagtgcgtctttgacgccatcgacacggtggagctctgcctgcctgtgttcaccgccatgctggacaccctcaccgtgcggaaggagaacatgcgccgggcggccgccggcggcttcatcaacgccaccgactgcgctgactacctggtgaagaaggggatgcccttccgggaggcctacctgatcgtgggccgactggtcagccagtgcatcagagccggtgagaccctggacaccctgtccctcaaggacttcaaggccgtatccaaggtctttgacgaggatgtgtaccaggccctggagctcaggacctgcgtcaacggccgcaaggtctgcggcggcccggcggcggacagcgtccgggtgcagatcggacatatcagggaattcgtggagacacgcagacatggataagccgaaggtctttatcgacggccgggagggcaccactggccttcagctctgggagcggctctcccggcggaccgatctcgaactgctgcgcatcggcgaggccaggcgcaaggacccggcggagcggaaaaaatacctcaacgcggccgacctggtgtttctctgcctgcccgatgccgccgcctgggaggcggtggggctcattgagaacgggcacacccggatcatcgatgcctccaccgcccaccgtaccgcctccggctgggtctatggcttcccggagctgtacaaggacccagagcgcatcatcggacaggcccgtcgggtggctaatcccggctgccacgccaccggcttcctggcctcgccagcccccctgtccgccctccatattctgctccgggactgccccctcacctgcttctccctcactggctactccggcggaggcagaaagatgatcgcccagtatgaggcccccgacaagccggccgagctgttcagtccccggctctacggcaccggcctgcgccacaagcacctgaccgagatgcagaaggtggccgggctggagcagcccccggtgttctgccccgtggtggacgactactacaagggcatggctaccaccatccaactccacaaccgctatctgcggggccagcccaccgcccgggagatctgccacatcctggcggcctactacgccggccagcccctggtctcggtgcgctggggcggggatgcccccaccctccccgccaacgctctggcgggcaccgaccggctggagctggtggtgtgcggccacgaggagcagaccatcgtcaccgccctcttcgataacctgggcaaaggcgcctctggcgcggcggtgcagaacatgaacctgatgctgggctttgagatgacggcgggcctggccctggaaaccccaccggcgggcagtcccgcctcagcaaggagtgagcgaacatgaagcagatacccggcggcgtcaccgcccccaagggcttccgggcctggggggttcactgcggcgtcaagagcaaaaaggcagacaagaaggacctggccctcatcctctccgaccaggagtgcgcggcggcggccgtgtacaccatgaaccgggtcaaggccgcccctctctatgtcactatggaacacctggaggacggcaccgcctggggcgtggcggccaacagcggcaacgccaacgcctgctgccccatgagccacgagtacgccgaggagatggcccggctggccgcccgggccaccggccgcgcacccgccgacttcgtggtggcctccaccggcgtcatcggccagaccctcaacatcgccgccatccgggcggggatgccggcggcggcggcgggcctcaccgccgggccggaaggctccgacgcggcggcccgcgccatcatgaccaccgacacggtgaagaaggagcttgccctcgcctgctctatcggcggcaggaccgtgacactcggcgccatcgccaagggctccggcatgatccaccccaacatgggcaccatgctgtgcttcgtcacaaccgactgcgccatcacccgggagatgctctccgaggccctccgcgaggtggtcccccgcaccttcaaccgggtgacggtggacggggacacctccaccaacgacatgtgcgcggtgctggccaacggcatggcgggcaatcccctcatcgagtggaaggatgacggctacaccgtctttctgaaggccctccgccagctctgccaggagctggcccgggccatcgccggggacggcgagggggccagccgcctcatcacctgcgccgtgcgggaggcccgcagcgaggagagcgccgagcgcctggccaaggcggtggtgggctcccccctggtgaaggccgccatgttcggcgccgacgcaaactggggccgggtgctgtgtgccatgggctactccaaggcccccttccgccccgagtatgtggacatttccttctcctccgccgtgggtgctgtggccgtctgccggggcggcatgggtctggacttcgacgaggaggccgcccggagcatcctctcccaggacgaggtggtcatcgacgtccacctccacgagggagagcacgaggccacctgctggggctgcgacctgacgtacgaatatgtgaagatcaacggcgattacagaacatgagaggcgcagcccgcgcccctctccccaaggaggcgaaccccatgtccgacgtgaccctgcgggcccaggtgctggccgaggccctgccctacatccagaagtattacggaaagaccatcgtcatcaaatatggcggcagcgccatgatctcccgggagctgcgggaagccgtcatcggcgacgtcattctcctcagcctagtgggcatccatgtggtggtggtccacggcggcgggccggagatctctgccatgttgaagaagctgggcaaggagtcccgcttcgtggacggcctgcgctgtaccgacgccgagaccatggacgtggtgcagcaggtgctctgcggcaaggtgaacaagaacctggcggccaccctcaaccgccggggcgggcgggccatcggcctgtgcggcttggacgccggtctgttccaggccagactgctggacgcgaagtacggtctggtgggcgagctcgccagggtggaccccgccccggtccgggactgcctgacggctggctacatccccgtggtgtccaccgtggctcagggggtggacggcgaaaacgcctacaacatcaacgccgacacggctgccgccaggctggcggtggctctgggggcagagaagctcatcctcctcaccgacgtgcacggcctgctgcgggatccggcggacgagagcacccttctccagaaggtgggcctgtccgaggtgcccctgctggtgcgggagggggtcatccagggaggcatgattcccaaggtggagtgctgcgtggaggcggtgcgctccggcgtggagcgcacccacatcctggacggtcgcatcccccactccattctcatcgagctgctctccgacgagggcatcggcaccatgatcctgtaaggaggcgcagacatgacctttgacgaactcaaggcgctggaccacgcccacaccctccagacctacggccgcttcgacgtggacgtggaccacggacagggggccaccctttgggacctggccggcaggacatacatcgacttcacctcgggcatcggggtgtgctcggtgggctacgggaacgagaagtgggcccgggccatctacgaccaggccctcaccctgggccacatctccaacctgttctactcccagccctacgcccggctggccggcgccctctgcgcccggtcgggcatggcggcggccttcttcggcaactcgggcgcggaggccaacgaggggcttctcaagctggcccgcaaatacagccacgacaagtacggcgccggccgcggcaccatcctgaccctgcgcaactcctttcacggccgcaccctcgccacccttgccgccaccggccaggacgtgttccaccaacacttcttccccttcccggagggcttccgccacaccggcgccaacgatctggccgacgtggaggcccaggccggggaggacgtgtgcgccgtgctgctggagctggtccagggcgagggcggcgtgctccctatggaccgggacttcgtctgcgccctggccggcctgtgcgagcagcgggactggctgctgctggtggacgaggtgcagaccggcatcggccgcaccggcaccctcttcgccttccagcagtacggcatccggcccgatgccgtctcctttgccaagggcatcgccggcggcctgcccatgggcggcttccttgtgaacgagaagtgccggccggtgctgggccccggcagccacgcctccacctttgggggcaaccccgtctgctccgcagccgctctggcggtgctggacatcctggacgaggcggccctgaaccgggtcagggagaagggggcctatctgcgtgagcgcatcgaggctatgggcaagcggtgcctgggcgccacccggggcctgggcctcatgatcggggtagaggtccgccccggctggagcaacagggagctggtcgcccggctggccggacacggcctgctggtgctcaccgccggccccgccctgcggctgttgccccccctgaccatcacgaagggcgagatggaccagggcctggccatcctggaccggggcctggagtgaccccgggctgcgcccgccatttttgtatgaggtgaacgagatgaaagacctgctgaagctgctggacctctccagagaggagatcgtccgcatcctggacgtggctgaccagatgaagtacgaccagaagcaccgcctgccccacccccgcctccagggcaagaccctggccatgatcttcgagaagaactccacccgcacccgggtctcctttgagaacggcatgttccagctagggggccacgccctcttcctctccggcagggagagccagatcggccggggcgagccggtggaggacaccgcccgggtgctctcccgctactgcgacggcatcatgatccgcacctactcccaggaggaggtggagaagctggcccggtatgccgacatccccgtcatcaacggcctcaccgacttcgcccacccctgccaggtgctggccgacctcatgaccatccgggagcgcaaggccaggctggaggggctgaagatgtgcttcatcggcgacggcaacaacatggtcaactccctcatcgtgggctgcctgaaggtgggcatggaggtgtccgtggcctgccccgagggctatgacccccaccccgatgtgctggccttcgcccgggaggcgggccacgggttctccctggtgcgggatcccctggaggccgcggcgggggtcgacgtggtgttcaccgacgtgtgggcctccatgggccaggaggaggaggccgcccagcggcgggccgccttccggggctaccaggtcaacgaggccctgatggccgttaccgatcccagctgcatggtgcagcactgcctgcccgcccaccggggggaggagatcaccgccggggtctttgaggcccacgccggcgagatcttcgacgaggcggagaaccgcctccacgcccagaaggccgtcctctgtctcctgatgggcgaggacgcccggtaaacggccgccccagcctgcgcagcagtttgccgaaagaaatgcacgggagctctcatactgaaagacggccccgggccgcgctgtgcgcggtccggggccgtctctgcgtccgggcttgtgttgtcaatggtcaggccgcacctgtgcagaagcgcatcagaatggcggccgcctgggcccgggtcgccccaccgccgggcttcagggcagcgggaccggtcccgctgatgaggccgccggcattggcccactgcataggccccacggcataggggctgatcttctctgcatccgcataggcggacatatctgccctagctgacacatcgcggccctggctgcgggcgtagcggtaaaggatggcggccatctgctcccgggtgatggtgtcccctggtccgaaacgcccgtctccatacggtggaggatggtcacgatcatcccccgggtggtagtcacctccggggaaaatcgtccgtcgccggtgccggccatgaggcccgcttcggcggcgtagcgcactgcgctctcataccaggccccggataccacgtccacaaagaagggctccgcgccgggcttggtgaagtatgccaccacactgtcgccggagagctcgcccgtcttggcggcgctccactccgctgctccggcgtcggccttcacgctcagggtatagctgccggttagttcggcgccggtgaccttgatgatgatgacggggacggaggcacctcgcttcatggtgatggtaatggtcccgtcctcccacttctggtcgtacaggtcggcactgatggtcttgtcataggacacacggacctcatgctactggcctcaacacccaggttgcccagcttgtctacgggtaccacgctatacctataggtcaggttgttggccgcgcccagatcatccgtgtaggtatccgaggtggtaaagccgatggccttgccgttacggcggatctcatagcccagcagtttttcactgtcggcgtgcctcatggtcagagtcaccctgggttacggcgtatcactttccacccggggagaaagccgttctctttattttatccccccgcagaatttgagctattcatctcttttctggccccacccccgctgtaatcctttgccgcggcgacgaagtcccggaacaggggatgggccctattcggccgggacttgaactccgggtggaactggacggccaggaaccagggatgatccggcagctccaccatctccactagcttcccgtcgggggacaggccggacaggaccaaccccttctccgtcagcagggaacggaagtcgttgttaaactcatagcggtggcggtggcgctcggagatatcctccgcaccgtaggcctgataggctctggtgtcatgcgtcgtgatataacaggggtaagcacccagacgcatggtcccgcccttgtcagtgatgccttgctggtcgggcatcaggtcaatgaccggatgggcggtggctgccagttcactggaatgagcatcggtcagaccggccacatggcgggcgaactccaccaccgccatctgcatccccaggcagatgccgagatagggaacctgattctcgcgggcccaacagacggcggagatcatcccctcgattccccggttcccaaaaccgccgggcacgatgatcccagcgcacccagccagcagttccgcggcattgctgtcgttgatgtcctcggagtccacccaacggacatccacctgcaccccgttttcgatcccaccgtgggtcagcgcctccaccacggagatataagcgtcgtggagggccacatatttccccaccagggcgatctccaaccggcccgccgggcgtttggctcgctccaccatggcacgccactcctccaggtggggcttactgacgggaagtcccaatacctcgcacaccgcttttgccaacccggcctcctccagcatcagcggcacttcgtagaggatgggggcggtctcgttggagatgacccgctccggcggcacattgcagaacagggcgatcttgtcccgcaccttctgggacaccggcccgtcgcagcggcagaggatcacatccggctggatgcccaggcccagcagctcctttacagaatgctgggtgggcttgctcttgggctccccggtgccgggaatggagacgatgagggagacgtggaggtaaagcacattctgccgccccacctcagcggccacctgacggatggcctccaggaagggctgggactcgatgtctcccaccgtgccgccgatctcggtgatgaccacgtccacctcctcccggcggccaacccggtagatgcgctccttgatctcaccggtgatgtgtgggatgacctggaccgtgccccccaagaaggccccctcacgctcccggctgaggacggaccagtagacctttccggaggtgatggaggagtccaccgtcaaatcttcgtcggtgaacctctcgtaatggcccaagtccaggtcggtctccgccccgtcctcggtaacgaacacctccccgtgctgataggggttcatagtgcccgggtcaatgttcaggtaggggtcgaacttctggagggccaccttcagcccccgggccttcagtagccgtcccagagaggccgccgctattcctttccccaggccggataccaccccgccggtgatgaagatatactttgccataccgatccctcccttgggtaagttggaagttcaagttttgacgcgtcagaacccgctggccccgtaatttttcagtgcccgggcggaggggtcatccacgttgcagccctcccaggcccgatttggcatccagaagtccttgatcatccgggcctggccggggtagtaccgctcgaacaggtcccgatagagcaggctctcccgggtgaagggcgggcggtactggtattgggcgcagccccgagtgaaagctaggtcgctgtactgcgctctggcatattccttcagatcatccaccatagagtggcccaccgcgtcggagaaggccgccttctcccgccacaggatctcgtcaggcagcagagcatcggactggaaggcccggcggagcagatacttgcccttgccgcagcggttgaccttcaacgccgggtccaccgacatgacatactccacaaagtccaggtcccagaagggcacccgggcctccatggaccagccgctgatacaccgatccgcccggagcacatcgtacatgtagagctcctccacccgcttttccgcctcagcctggaaggcagcgggagagggggcaaagtcggtgtacttatagccgaagagctcgtcggagatctccccggtgaggagcacccggatgtcggtagtctcgcggatggccttgcagcacaggtacatgcctacgctggcccggatggtggtaatgtcccaggtgcccagggcggccaccactttgggaagagcggctatcacgtcgtcccgggtgatgatcacctccgtgtggtccgccccgatgaactgcgccgccttccgagcgtacttcagatcgatggcgtcggtgtccatgccgatagcgaaggtgcggataggctttccaagcagccgggcggcgatggcgcacaccaggctggagtccagtccgccagagagaagaaagcccaggggggcatcggcgtccagccgcttgtccaccgcggcgataagcttgtcatggatgttctggcagacggtgtccatgtcgtcggaccggctgaggccgggacgggcggggttggcgtagcggacaaaccgtccccggtaccagtagtgtcccggagggaaagggaggatctgctcacacaggcccaccagctgcttggcctcgctggcgaagagaatgccgccgtcaggatcgcagccatagaagaggggccggatgccaatggggtcccgggcggcaacgtattcgtccgcctccccatcgtagaggatcagggcgaactccgcgtccagccgggcaaacatgtccagcccgtactcccggtacatgggcagcaggagctcgcagtcgctgccgctgcggaaggtgtagcccctctgctccagctctgcgcgctgcctccgccagccgtagagctccccgttgcacaccacctggtcaggccccagggcgaagggctgcatcccacgctcgtccagccccataatggacagacggcgaaagcccagccagccggaggcggtttccgccacccgggccatgtcagggcccctggtataggcccggtccagacaggccaagacctcttcccgccccctggtcttttgggtaaatcccacgatcacgcacatagaaagcacctccaaaaatgtttgcgcagccctcgtcctcttgattaggacgaatgctgcgctccgcggtgccacctaatttgccgccggacggcggccccttttccggctctgacaagtcggcgcgatgtaacggtcgcagcccgttccccctactggcgcggtgcgttcgggtttccgctccggagcgttcttcccgcggcctcctgtgcggggctttcaccatcccccgctcgctgggactgagtccccgcagtactcttctccctcattgcgtttaacggtattgcctgaaaaaacggacaagggcgctgtggtccatgccacagcgcccttgctgttatgggatattatagtgaccgccgcccccattgtcaagaaaaactttcggcgggcgtccccaatttccctcagaggcggatgggatagttgccagtgaagcatccgtcgcaaaagccgcagccagcgtccggggcgatctgatgtaggatcttcagcggcagaaagcctaggctgtccgcgccggtgagggcgcaaatctcctccggggagcggtcatgagcgatcaggtgctcactgtccggaatgtccgtcccgaagtagcagggggcgatgaagggcggtgcggagatgcgcaggtggacctgcacggcgccggcctcccgcagcaggactacgatctggcgggaggtggtgccccagacgatggagtcgtcgatcatcaccacccgcctcccctccacacagctgcgcagcgcccccaacttaatgcgcaccgcctgctcccggctgcgctgatccggggtaatgaaagtgcagccgatatagcggtttttgaccagacccactccataggggaatcctcgactcctccgcataacccatggctgcgtccagaccggaatctgggatgccgatgactacatccgcctccaccggccaggtctgagccagcagccggcctgcccgccgccgggcctcatagacggactgaccgcagagcatggagtccggccgggcgaaataaatgtgcctgccgcccctttgtcaagagctccccataccggcggtgcagatagctcatttatgaaagtctattttatacttcctgcacaaatatggagggccgtctggctatttgtcttagtggcgaagcaaaattgagttgaacttgcaaaaacatcttgacatggaattgcggttcgcgtataatttgcccatagtttaggacaaaggcgttccgaaccaacaggtcggcctgcctttgtcctctttttattttaactttacttgaaagaatgagaggagtgtcctgcatgtcgtacagcaaggaagacatcatccgtatggtaaaagaagaggatgtggagttcatccgccttcaattcaccgacattttcggtcagctcaagaacgtggccatcaccgcatctcagattgagaaggcggtgaatgaccaggtcatgttcgacggctcctccatcgagggttttgtccgcatcgacgagtcggatcagtacctgtaccccgacctggactccttcgccatcttcccctggcggcccagccacggcagggtagcccggctcatctgtgacgtccatgacccggacggaaaacccttcgtgggcgacccccggcacgtcctcaagcgggctctgaaaagggcggaggagatgggctttgatgccttcaacgtaggtccagaggcggaattcttcctcttccagactgatgacgagggcaagcccaccacccgtaccaacgacgaggcgggctacttcgatctgggccccctggaccacggggagggcacccggcgggagatctgcatggccctagagcagatgggctttgagatcgaggccagccaccacgaggtagcccagggccagcacgagatcgacttcaagtacgccgacgccctgcgtaccgcggacaacattatgaccttcaagctggcagtcaagaccctagcccagaaaaatggcctccacgccacctttatgcccaagcccatcttcggcatcaatggctcggggatgcacactaacatgtccctgttccagggcgggaaaaatgccttctacgacccggatgacccaaagggcctgtctaaagaggcatattccttcatcgccggtctgctggcccacgtgaagggcatggcggcggtgaccaaccccctggtgaactcctataagcggctggtgcccggctacgaggctccctgctacctggcctggtctgcctccaaccgctccgcccttatccgtatccccgccgcccgggggcagtccacccgggtggagctccgctctcccgacccggcctgcaacccctacctggagctggctgtctgtctggccgccgggctggacggcatcgagaagggcctcaccccgcccccggaggtcaccgagaacatcttcgacatgaatgccgccgcccgaaaagctcacggcatcgactctctgcccgactccctggaggaggccatccacgctctggaggccgatcccttggtgctggacaccctgggagagcatgtggcagccaactatattgagggcaagcggaaggaatgggaggagtaccgcacccgcgtctcctcctgggaacgggagaagtacatcatcaattattaaagcgatcccatcccaacaggggagtgaacgcacatggaaaagatcattgtggcctttgagagcgaaaagaccgccctgcgtgtaaaggaactgctggaggggggcggcgcggccgcctgcttggtgtgccgcaccgccgaccaggtgcggcgggccataaacaagctgccagtgccggcggtggtgtgcggctacaagctgggggatcagacggcggagctgttctttgaagacctgcccctctcctgcgccatgctggtgctggctcaccaggaccgattggatcttctggggaatgacgacatcttccgcctgccatccccggtaagccgtggggatctgctggctgcggtgcggctgctgctgcaagtggggcgcaggctggagcggtacgggcgcccctgtcacagtggggaggatcggagactcatcgaccgggctaaggccctgctcatggaccgccatggcataacagaggagcaggcccattactatttgcagaaaaaaagtatggacagcaggacaaaattggcccagaccgcccggctggtgctggacagcaaaacgatggaatagaggcggagacgaggtggtctcacggcgacggtcgggagacggaccgccgccgtttttatggaaagaggcgagacgcatgagggaaaaagcggctgaagggagagggctgtaccgcccggaattcgagcatgacgcctgcggcattggcgccgtggtggacatacagggccgggccagtcatgagacagtggacgatgccctgaagatcgtggagaagctggagcaccgggcgggcaaggatgccgagggtaagaccggcgacggggtgggcatactcacccagatctcccacgcgttttttgccagggcggcggcggaggcgagcatcgccctgcccggacggcgggactacggcgtgggcatgttcttcctgcctcgggacggtttgaaacgccggcaggcccagagacagttcgaactggtgaccgagaaggaaggcatggctttcctgggctggcgggaggtgcccgtgcacccggagattctgggccagcgagccagggacaaaatgcctagcatcttccaggcttttgtggccaggccggaggaaacggctcccggcttggattttgaccgaaagctctatgtagcccggcgggtattcgagcatctgagcggggacacctacgtggtctccctgtccagtcgcaccgtggtctacaagggcatgttcctggttcaccagttgcgggccttctaccccgacctgcaaagcataaactatacctccgccttggccatcgtccactcccggttctcgaccaacaccaacccctcctgggagcgggcccaccccaaccggctaatagcccacaacggggagatcaacaccatccggggcaacatggaccggatgctggcccgggaggagaccatgttttcccccctgctggcaacggatagggacaaggtgctgccggtggtgaacgcctccggctctgattccgccatgctggacaacaccctggagttcctgatgatggcggggatggaccttcccctggcggtgatggcctgcatccctgagccctggcggaatgaccgcaccctctcccgctcccgccgggacctataccactactacgccaccctcatggagccctgggatggcccggcggccatcctgttctccgacggggacgtggtgggagcggtgctggaccgcaacggcctgcgccctgcccggtactacctcaccgacgacagccggctcattctctcctccgaggtgggggtgctggacatcccaccggagcatatcgtggaaaagtcccggctgcggccgggcaagatgctgctggcggacctgaggcaggggcggatcattgacgaccaggaactgaaggagggctacgccgcccggcagccctatggagagtggctggacaccaatctgctccgtctggccgacctgccgatcccaaaccagcgggtggagcggcacagccgggaggaacttagccgccttcagaaggccttcggctacacctatgaggacgtgaacgacaccatcctgcccatggcccgcaccggggcggagcccaccgccgccatgggggtggatatccccctggcggtgctggacaacagggatcggcccctcttctcctacttcaagcagctcttcgcccaggtgaccaacccacccatggatgctatccgggaggagatcgtcaccgacaccaccgtctacgcggccgatgacgggaatctgctccaggaacagccggacaactgccgggtgctccagatccacaaccccgttctcacctccaccgacctgatgaagatcaaggccataaaccgacctggcttccacgcagccaccgtgtccctgctctattacaagggcacccacctggatctggtactggaccggctggcggtggcggtggacagggcgtaccgggagggggccaacattgtcatcctttccgaccggggggtggacgagaaccacgcggccatcccctctctgctggcggtgtctgccatggagcagcacctggttcgcaccgggaagcgcaccgccgtatctatcctcctggaatccgctgagccccgggaggtccaccacttcgccgccctgctgggctatggcgcccgggcagtgaacccctacttggcggaggagaccatcgtggatctgatcgaggagggcctgctggacaaggacttccacaccgcagtggccgactacaccgccgccgtcctccacggagtggtgaagatcgcctccaaaatgggcatctccaccctccagtcctaccagtctgcccagatcttcgaagcggtgggcatacggcaggatgtaatcgacaagtactttaccaacaccgtctcacgggtggggggcatcggcctggaggagatggccgccgcagtggagcggaaccacgaccgcgccttcgaccccttgggacaggagactgacctgaccttggagagcctgggggagcacaaggcccgagccggtggggaggaccacctctataatccacagaccatccacctgctccagcaggccgtccgctgggaggattacgggctcttcaagcggtacaccgccctggtggacgatgagacaaagccccacaccctccgtggcctgatggagatgaaatatctgggcgagcccatccccttagaggaggtggagagcgaggattctatcgtcaaacgcttcaagaccggggccatgagctacggctccatctcccgtgaggcccacgagtgcctggcccaagccatgaacctgctggggggcaagtccaactccggcgaggggggcgaggaagacgaccggctgggggacccggagcggtactccgccatcaagcaggtggcctccggccgcttcggggtcaccagcgcctacctggtgagcgccagagagatccagatcaaaatggggcagggggccaagcccggcgagggcggccacctgcccgccgggaaagtctacccatggatcgcttggtgccgccactccacccccggcgtcaccctgatctctcctccgccccaccacgacatctactccatcgaggatctggcccaactgatctatgatttgaagtgcgccaaccgtcaggcccgcatctcggtgaagctggtcagcgaggcgggggtgggtaccgtcgctgccggggtggccaaggcaggggcccaggtgatcctcatctccggccacgacggaggcaccggcgcggcccctcgtacctccatccacaacgccggtctgccctgggatcagggtctggcggaggcccaccagaccctgatccaaaacggcctgcggtcccatgtggtgctggagactgacggcaagctcatgagcggccgggacgtggctatcgcctgtatgctgggagcggaggagttcggcttcgccaccgcccctctggtcactcttggctgcgtcatgatgcgggtgtgtaacctggacacctgccccgtgggggtggccactcagaacccggagctgcggaaacggttcacaggcaagccggagtacgtggtcaacttcatgcgcttcgtcgcccgggaactacgggagcatatggcccggcttggggtgcgcacggtggaccagctggtaggccgcaccgacctgctgcgggtacggaagcccgccgtcaaccagcgggcggccacggtggacttgtccgccattctggacagtgcttacgccggctggccaaagacccgctttgatccggcggacgcctatgacttccgtctggaggacacagtggatctgcgggtactggaacagaagctgggcgtcgcccttgagaaaggcgaccataggcggctggaactggcggtgtcctccaccgaccgggcagtggggactatccttggttcggatatcactctcctccacggggaggcactccccgacgacacctttgtggtaaagtgtaccggcgggggaggccagtccttcggcgccttcctgccccgcggcctcaccctggagctggagggggacgccaacgactacctgggcaagggcctctccggagggaggatcatcgtctatccgcccaaggacagcccctttgacccggcagagaacattctggtgggcaacgtggccctctatggagccacctccggccaggcctttctcaacggcgtgaccggggagcggttctgcgtgcgcaactccggcgccgacgcggtggtggagggagtgggggaccacggatgcgagtatatgaccgggggccgggtggtaatcctgggccccacgggccgcaatttcgccgccggcatgagcggtgggatagcgtatgtgctggacgaggaccatgacctgtacctgcggctgaacaaggaactggtgtccatgggcccggtcacggaagagggagatatagaagcgctgcgaggcctgatccaggctcacgcagaggccaccggctcccccaaagccggacgaattttggccaatttcggagcctggttgcctaaattcaagaagattttgccccacgactacgaccggatgttgcgtaccatcgcctggtacgaggcccagggtatgggccgggtccaggcagagacggaggcgttctatgtcaacgccagaggaaagggggactgaccgtgggaaagcccactggatttctggaatatgcccggcagggcaatcactgccagccaccgctggagcgggtggcgtactggaacgaattccatccccggctgggccgggaggagcggcaacggcagggggcccggtgcatggcctgcggcgtgcccttctgtcagtcaggggcggtgttgaacggtatggtctccggctgcccactgcacaatctggtgcccgagtggaacgacctggtgtaccgcagaaagcttggccgcgctttggagcggctactgaaaaccaacgacttcccagagttcaccggccgggtgtgccccgccttgtgtgaggcggcctgcacctgcggcctaaacggccagccggtgacggtgaaggacaacgagctggggatcatcgaggaggcctgggagcagggactcatgtaccctcggccgcccgagacccgcaccggtaggaccgtggcggtggtgggctccggccccgccgggctctcctgcgctcaaaggcttaaccgccgaggtcacagcgtcaccgtgttcgagcgggccgaccgacctggcggcctgctgatgtacggcatccccaacatgaagctggaaaagtcggtggtccagcggcggctggatctgatggcggcggaggggatagccttccgcaccggtgtggacgcgggccgggacgtgggtcaggaggagctgagggaacagtttgacgcggtggttctctgctgcggcgcggcccagccccgagatctggacgtaccaggtcgggcgggagtggacgtctggtttgcagtggacttcctgacaggggcaacccgtgccctgctggatgggacttactgtccctctgcacagggcaaggatgtggtcatcgtagggggcggcgacacgggcaacgactgcgtgggcacctgtatccgccagggctgtaaaagcgttacccagttggagataatgcgtaaagccacaggcgcccgcaccgccaagaacccctggccggagtggccgcgggtgtgtaaaacagactacggtcaagaggaggccatcgccatctttggtcgtgaccccaggatctacgagaccaccgtctcacacctgcttcgggatgcggaggggcacctcaccggggtggagaccgtcctgctggggccggaccgcaagcctctgacaggaacggagaaactgctgccctgccaactgctgcttatcgctgtcggcttcctgggcccccaggactatgtgccggaggccttcggactgacgcgcactccctgctccactgtacagacagcggaggtgagctattccaccaacatccccggcgtgttcaccgccggggacatgcgccggggacagtccctggtggtgtgggccattcgggagggccgcgaagccgcctgggaagtggacaggtacctgatgggacacggcgagtggaccgagctcccgctgattcagacagattgaaaaacagaaggcccggtcggtgcccgcattatgcagcactagataaggatacatcgtgaaccaggggttcatatcattttctcttagcatggtccaaacagtctgctaggaactctgcaaaatttgtggagttcctatttttgtgctcgaaattgtgcctattgaatatatcatgcttactatttatagagaaaatgccgatgcactaagaattgaattccacaaatccttgagaattattttgagcagacgataaaatcaacaaatatgttgattttattttgaaattttctttcaaaaaattgccgcatccactataatggctgtaaagtcatgcgagaggggaatcttcatggatgcggaaaaagtgacaaagaaccatgtttcctatatttattcgaaggagatcatactgaaaaatctattgcaacaagggatcatttcgaatcaagattttgatcggtatgatcaaatgttgtatgaccgataccatatggacagcagtcttggcatttcgcgaccaattatttctagtcaatcggctgagttgcctgacgcagatcaatccgattttacatatctctcccttacggatgaagctcggtctgtcaatcaagaccagccgggctatgtgattcaaagctggctgcgggatcgtacaacgatctctttcctacactattgggaaacgcagaataatgaaaactttgatgcagcaggctataaggcgttagaggaggaattaaaaagtcctacattaacactgactgctaaaaagtggatagaagctacgagggcgatcgggcttcgctcaaagcaagggaaaaatggcggaacatatgctcatcctgagattgcctgtgtattccgtgcgtggcttcatcctgaataccagtatacacttgtccagtccttcctgcacgatagaaaaagaaaggcgggcagagatgaacaagcgtaaaaatgaagtgatcgaaattcctgcaaagcccgtggagacagatcaaccagtaaagcgtcaactgcgtgttgctgcatactgccgcgtatctaccagtcaggagtctcagcaaaacagttatcaagcgcagaaagcgtattatacagataaaattgcgtcaaatcctgattggtgtcttgctggtattttcgctgatgaagggattagcggaacttccgcagaaaaacgtcctgcgtttcagcgaatgataaggtgctgcaagaaagggaaaatagacttgatccttaccaaatccatttcacggttgagtagaaatacggtagattgcctccaatacgtgaggctgctgcaagagctgaggattccagttatttttgaagctgagggaatcaacaccttaaatatgcagaacgagttccttcttgctgtgatgggggcgaactcgcaagcagagagcgaagctaccagcagccgagtcaaatggggtgtcagaaacgcttttcgtgagggaaaggtgaggtactattatcagtactggctgggctacagaaaggggaaggatggaacacccgaaatcattccggaggaagctgagactgtaaagcagatctacgcggactacctttccggcaagagcctacgatcgattgcagactctttggagagcagaggaattttgccaagagccgggcaggcaaaatggacaacgacctatattcggggtattctgcaaaatgaacgatatacgggagacgctctgctgcagaaaacctacacaacagatcctattactaagaaacaaaagaaaaacaggggtgagcttccgcagtatcttgtgaaaaactgtcatccagccattatatctcacgaattatttgatttggttcaaaaagagatctccaggcgcagtgtagcaactggaaattcggatgcggacagcgcacgcccgaaacccgcctattccggaaaatatacgctttctgagcttttagtatgcggagaatgcaacacgctgtatcggcgttgcacatggaaagggaataagggaacacgcattgtctggcgttgtagaagccgtcttgatcatggtaagaaatattgcaagcattctccaacgttagacgaggcggcaattcatcaagctctggtaaaagcaatcaatcaacagttagtacgcccggaatacctgcttgctccgtttgaaaaaatcccttttcatctttccgcttttcctgtccctgctaaatcgtggccggaattgtattccaatctcctggagcggcaaagtatgcttgatacagaaatcgttgacctcattgcagagtatgcagccaatgaagactggaacggagaaagcgaactgcttatagagatcttaagagagcgaaacaagtgtgccaactatatctccatattccggctagaccgatatggaagagatttttcccaggacagatttcattttccatattgcctgacggaatacaacgatgctgtcgtccgctatgtggtagacaccattaaagtgttggataaacagcacttgcagatcacttttaagggaggcctcgttgtagaacagaaaatcccctccaattagctgcaatatcgagcgaaatacctagggtaccttcggcccgcgccttgattggcgcgggccgttctatgttgaagctgcaaaacggggcaggatccctcatagactcttccaggaggtgtttttatgagtaagacaacgatgatcgtccattgtgagtattcaggtacaggccagacattagaaaaattggtacagagttctttctatactttcctgaaaaaggagctgtctgagctagctatttgtcgagatgtgtagtatgcttgtgtcgatgaatggccgcttatctcaggaggtatagcatgtacttagagataagcaatcccatggattaccatgcggggttatacatcagactatcaaaggaggatgagagcgaggggccatcgcagagcgtccagaaccaggaatccctgctgcgggagtttgtacagcagcaccggctgagcgtctacgatacctatattgacgacggctggagcggcactaacttcgaccggccggccttccagcggatgattgcggacatcgaggccaaaaaggtcaatatggtcatcaccaaggatctctcccgactgggccgggactacattctgaccggccactacatggagcggtacttccccgagcaccgggtgcggtacatctccctgctggacggcatcgacaccggcgtggactccaccgccaacgacattacccccttccgggctatcatgaacgacatgtacgccaaggatatctccaagaagatcaagagcgtcaagcgggataagcagcggaagggacagtttatcggcggcaagccggtgtacggctacaagatgcacccaacggagaaaaacaagatcgtcattgatgaggaagtggcccctatcgtgcggcggatcttcgccctggccctctcaggcatgagctgccggaatatcgccactctcctcaaccaggagggagtacctaccccggcaacctacgcgggtctcccggtggcaagacccggtccctacaccgggctgtggagcagtgaacgaatctccgacatgctgcaaaatgagacctacatcggcaacatggtacaggggcgcagcgtgaagatcagttacaagtccaagaagtgcctgaagcaaaacccagccaactgggtggtggtggagggtacccacgagcctctggtggacagagagacctttcagaaggtgcggatgctggtgaacagccgcaggcacacccggagccggacctatgacttcctgctgaaaggactgatcttctgccacgagtgtggctaccctctgacggttctcaaccggaaaaactccaagggagaggatgtgctgtacttcgtctgccgcacctatcaacggttcaccaaggctggggtctgcacctgccattccatcaaggagaaaacggtgaccgatgtagtgatcgccaaggtgcgggaggtgtgccaggcgtatctgaacccagacgagctgctgcccgtggcacaggaagctgtggagaatgccagaaagcagagcagcctggagacagaactccaggccctccaatccaagatcgacagcctcaccgccaatctggaccggatgtataccgaccgactcagcgggctgctgccagaggcggacttccagcgcatcttcggccggatcaagctggaacgggagcagatggaggagaaacggcaggagttggagctgcgtcaaaaaagccctgtccgcagtgaggacagggcaagggaactggtacagcggttcatcgaaactgccggggaaagccgtgagctgctggtgagccttatcgagcgggtggagctcaccgaggacaaagagatcatcatcaaattccgcttcgcccagctggacgaaacggcggaaagccagataccgcaagggattgcgccgtcccacacggcgtaaatttccggcggaaatcgcttacaatagccggggcgctatgtatcgcgcattgagaaaaaagcactcaagaagctggaggcggccatgggggctcaggaataagcactcctgtgccgcggtacaaagcggcttgggcccagcaaaaaagggctttactcctagcggctgaatgggatataataaaatcgggaaaaaagagaggggcggcgcaataaaacgctgctcccgtacattaagaagatgacaggagcgcgacaccatgttaatcctgcttgagacaatggcagaggagcgccgcaccgccactgcgccggagctgctggagccgctgatggcccggctggccgggggggatcaggaggcgctggcagagctgtaccaccgcacgcggacgtcggtgtacggcctggccctatcctacctgaaaaaccagcatgacgctgaggatgtgacccaggacgcttttgtgcgggcctgggaaaacgcccatcagtaccgtccccagggtacaccgctggcctggctgctgaccatcgcccgcaacctcgccctgatgaagctgcgggagcggggcaggacccaggacatggctctggaggactgggaacggctggcagcggagaacccgatggtgacggtggaggaccggcaggtgctggacgccgccctcactgcgctggcggatgacgaacggcaaattgtgctgctccacgcggtgaccggctggaagcacagggagattgcaggcctgctggagctgcccctgtccacggtgctgtccaagtaccgccgcgcgctcctgaaactaaagacgaagctggaaggaggggatgccctgtgaccgatcaggaactggaacagcgtctgcgcaccgcgctggagcacgccgcgcccgaccatctggaggcgctcctctcccggtgcgaactgcggcggggaaacgtgattcccatgaccgtaccggcgcggaagccgcggaaaaaggcggccatggcctggcttgcggcggcctgcctggcgctggtggtggtgggcggaggcgccggtgttcagtattaccaggccaacgccgtggcttcggtcatctccctggatgtcaatcccagcgtggagctggatgtaaaccggcaggagaaggtggtctcggccgttccgctgaacgcggacgccaacgaaattctcgacggcatggacctgaagggggccgacctgaatgtggcggtcaacgccatcatgggctctctgctcaagcacggctatgtggacgaactggccaactccatcctcatctcggtggaggacgacgacgcggcccggggcgcagccctggagcagaagctgaccacggaaatcgggcaggtgctcgactccgccaaagtcaacggagcgatcctctcccagaccctcagtggggacagcgcccttcagcaaaaggcggacgagtatggcatctcgctgggcaaggccacgctgatccagtccctggtggacagcagcaaccatctcacgtttgagtccctggtggggctgtccatcaatgagctgaatctgctggccaattccaccgcagtccagaccccggacagcgcggggggacagaccagcacgaccgcctccaacccggcgctaaactcggtaggtacagccagccagagcgcctatatcggtgtggaggccgccaaggaggccgccctgacccatgcgggtgtgaccagtggggacgtggtgttcctggaggctgactacgactatgaggacggccgtatggtatacgaggtggagttttttgccggaaacacggagtatgagtacgatgtagatgccgccaccggcgccattgtcaagcacgggcgggagcaaaagggcggcagcctgaccagcggcggaagtaccgctcagaccgacatcggcgaggcggcggccaaagccgcggccttcgcccatgcgggcgtggccgaaggggacgtgcgcgggctgacggtcaagcgggactttgacgatggccgcctgacctacgagctggaattctgggcaggtactacagagtacgagtacgagattgccgccgcggacggcagcgtgctcaagagcaagcgggaggagcactccaatgccctgcccgcggaccaggccatcgggcgggatgccgcccgggacgcggcgttggcccacgcgggggtggcgctgaccgacacctacgagctggaggtggaggaggagctggacgagcgcacgccctgctataaggtggagttcaaggccggcggcatggagtacgagtacaagatcgacgccagaaccggcggcgtgctcacctatgagatggatcgggactgacgcggcaaagcgccgccccggagcgacaggctccggggcggcgctttttctgaaaaggctcaaagctccatatccagcagataggaggacaggcccttgccgtgcatgtccacggagagggagcgggttacgccgccgcccagggcggcgtacatgacaaagttcagcgcatggatattgggcagctcatagcggaccacctcacccttgaccatgcccttgaagtgctccttcacccgctcagcggtgactctctccttgagcagcgcatagtccttggggtcgtaggcgatgagggagatgttggagatgttgcccttgtcgccggtgcgggagtgtgcgatatcccagagtttcatagaaaatgcctcctttctgtcttgaaatcagacttcaaagatctcgacttcgggcttaacatcgcagcggctcaccagaatggaggccacggacacgatgtcgcgggtgcgcttgacggcgccgcagccgccggctgggccgttggtgtagagggcctccacctcgttgccgatgagctcggcgtcggccctggccttggctcggccggacacgcggacccgcacctcgctgggctcttcgttgtacttgaagtcggggttccagtacaggctgttgcagccgatgaggtcgaacttcagctcgtcaaacacgccgggggccaccagctccaggcgttccttgatgatgtccagggccagcctaccgcgggccacgcagccggggcctccgtagctgatctcgccgtcgccgatgaagcagtccttgtagccgatggaacacttgaaggtctcggtcctgggcttgccggaggcgccctccaccttcactttatccttctccacctcggtaaacttgacctgcttgaagtcggccaccacatcgggggtcaggtagttctcgggatcgtgaatctcgtagacgatctgctcggagcaggtctccaccgtgaccatgccgccggactccggaatcttggtgacgaagaaggacccgtcctcggagatctccacaatggggaagcccaggtggcccaggccggggacatccttcttgccgggttcggcgaagtagccgccagtgacctggccgccgcactccaggaggtggcccatcatggtgcccttgcccagcttgtcccagtcctccagcgaccagccgaaggcgtggatggcgggggccatgaagatggcggggtcggctacgcgtccggtgatgaccacgtcggcgccctgctccagggctttcagaataccctccacgcccatgtaggcgttggcggagacgatctcaccggggagcttggacaggggctcgtgggtctcccacacctcggcgtccatgtacttgttgatgacgggcagcagatcgtcgccggtgacgcaggcgatcttcatgccggtcaggccgtgcctgcgggcaatctccacgcacttctgggcagcggcctggggattggcagagcccatgttggtgatgagcttcaccttgtgcttccagcacaggggaagggccttctccatgcggtgctccagaagaccgttgtatcccttggacgggtccttcagcttggcctgctgcccgatggcgatggtgcgctcggccaggcactcatagctgatatagtccaggttgcccttttcgatcagctccagtgagggctccagccggtcgccggcatagccggccccgctgccgatgcggatggttttcgtcatgcaatgacttcctttctgataattgacatttcaaagacgagagagcggctcagatggcgatgccgcgggtgagaatggcgacaaccaccatcaccagggacaccagccaggccagcgggatggtcttcttctggtgctcgccgaagtccacgccggacaggcccaccagcaggaaggtagaggcggtcagaggggagacggggaagccgatggtcatctgacccaggatagcggcgcggccgacatctacaccggcgacgccgaagccctcggcggtctgagccagcacggggagtacgccgtagtagaaggagtcgggatcaaagagcagggaggcgggcataccgatgatgccgatgatgagggggaagaacttgcccatcgtatgggggatgatggagactagcgtgctggccatctcggtgatcatgccggtgccctgcatgatgccggtgaagcagccggcggcgaagagcacggagcacatcatgagggcctccttggcgtgggcgtccacccgggccttggaatccttcacgctggggtagttgatgacggtggccagcacgtagaaggccatgaataccaccgcgggggcgaagccggagaacagcagggacacgatagcggccacaatgaggatgatgttcacccagaacaggtggggacgcagcagggccttctgctcctcggtgagctcctgctcggtatttccggcggcctggagagccacggcgccgatgcgctttttctcgccggctcccaggaatgcggagataaccagcacacataccaggcccaccagcacggcgggaaggacgggaaggaagaaggcgacggggttatcgcccatgcccagcgcggtggcggcacggatggtggggccgccccagggcaggatattcatggtgccggcggagagggccacaatggtggccagcgtagtgcggcgcatgccgagcgcgtcatacagaggaagcagcgcgggcacacagatcaggaaggtgaccgctccggagccgtccagatggacgatggcagccagaatggcggtgccgatgccgattttgacgggatcggtgcctaccaggttcagaatgcccttgatgatggggcgaaaggtgccggcatcggtcaggatgccaaagaacagaatggagaagatgaacatgacgccggtggccgccacggagccgatgcccttggagccggtgatcatgtcgcccaaggacttgaagttggcgaaaaagttcacaacaccctgcgttccctccgcggcgccctcaggtacgaccgcgataaagaaacaggagatgatgccggtgaccacggggaccacaatcagggccaccagcggagatgcttttttggtcataatcagtaccagcatgatgatgaccgtcaggaatccgagaattgctaaaggtgacattcacataacctcctcttatttcaagcaacctctccacacgctgcttgtgctaaaagaaatatgcaagcggcatgccaagatagggaggtgtggataaaggcgcaaaaacccgaccctcaggtagctccggggaaacaaagagcgggcagagagagggctggtttctaaaatattagaatccaatcgggcagaaaccaaatggtaactgcctctataggttggtgcggctggtttctaatttattagaatagaattctaataaattaaaactgcatattcaatttattgtaaaggctggcaagagagatgccaagctgtgcggctgtctttttcttaccctccagagaggcaccattgcgctctaataggcggagaatctccgcccgttcaaaggcccgggtacgctgggccagtgtgagagacggctgtgcagttggaccagtccggaggttttcggggagggacagctcggtgatgacgccggagggggtgagataggcgcagaactccagcacgttgcgcagctcccgcacattgcccggccagttgtgggccagcaggcggtccatggcctcgggcgtcagctccaggcgtcgcttgagcttgcgggacagctcgtccagcaggctgcggcagagaggagggatgtcctctctccgctcccgcagcggcgggatgtggatggggaaggtgttgaggcggtagaacaggtcggtgcggaatttcccctcctccacatagcggggcagatcggcgttgcaggcggcgatgatgcgcacgtcggtctccacctcctccacgccgcccaccggccggatgcggcgctcctggagggcgcgcagaagcttggcctggaggccgacgtccatctcggagatctcgtccagaaagagcgtcccgccggcggcggcctcaaagaggccgatcttcccgccccgcttggcgccggtgaaggccccctcggtatagccgaagagctcggactccagcatattggcgttgaagttggcgcagttgatggcaacgaacaccccggcggagcgggggctggcgttgtggatggcctgggcgtacagctcctttcccgtgccgctctccgactggagcaggatggtggcatcggtctgggccaggcggctggccagctcccggcaggccgccgaccggggggagaccgccacaatggagtcaaaggtgtagtgggcggcgttggccttgttgacccggcggagcacctgacggctgcgcttttcatagcgctccagctccgcccggaagtcgaaggcgtccttccaaaaggtaaccaccgacaggccgcccaccacctccgctccgtcgaagatggggtacatgttgacgaagtagatgtcctcgctctcctggcgcggggtgtgcaggatggggcgcttctgaaccagcacctccggcagccgggcaccggggcgcagtagccgcagggggtatccctcgatcggcccgatgggcccgccggcctccttctccagaaaggccacataggcccggtttccatagacaatgcgctcctgcgcgtcaatgatcagcacgccctcctgcatggcgtccaggactgcgcgggtgatgggatcaagctgcacggcggccgcctccttccgttctgcctgtattgtagcagagaagcatctggttgacaactggggcaatcccggttgacgaagcgtaggaaatcggttacaattccaacagataggcggaggagggaagaacgatggacaaggcggctatgccggagggaaagtatctggcctcggtgaagctggggccgaaggggcagatcgtggtgcccaaggaggtgcgggagatgttcggcgtccggcccggggacacgctgctgctgctggcggacgtgaaccgggggattgcactccagacctttgaaaaggcggatccggtcttccgtgatgtcttttcggaccgggagcaataaaagtgccgcgccttcaggcgcggcacttttatttcatcttgacattctgcctttgcggtgctataagtaagaaaagtattactaataagaaatagggtgcgtaatatgagccggatcgtctttttctccattcccgcctacggacacaccaatcccacggtggaggtggtgcggcagttggtgcgccgggggcaccgggtgcgctactactcctttgaggaattccgggcgaagctggagggcgcgggagccgagttcgtcccctgcgacgccttcctgccccccgcccctagggatctggggcggcggatggggcacgacttctccagcctcatggcgatggtgatcgatgtgacggtggccatggaggagaaggcgctccgggagctgggcgaattccggccggactgcgtggtagccgattccatctgcgtctggggcaagctgtacgcccggcggctggggctgccgctggtgtgctccaccaccaccttcgcctttgaccaagagaccgccagggagatgcgccccggcccgctggaggtattctacaccctggtgggcctgccccaaatcgggaagaggctggccctgctgcgggagcacgggtacgaggtggaaaagctcaccgacctgattcagaatgacagcgagaccgataccattgtctatacctcccgggccttccagcccggcggcgagcacttcggggagcgggtggcctttgtggggccgtccctcccggagctgccgccccggacgcagcggcgggagcggccgctggtgtacgtctccctcggtacggttatgcacgggaataccggcttttaccgggcctgcgcggagggcctaggggacgggccgtgggatgtgctgctgtcggtgggcagcccggagggggcggcagcgctgggcgctctgccccccaatgtccgggcagaggccagggtggagcagctccgggtgctgggggaggcgtcggtgtttctcacccactgcgggatgaacagcgtcagcgagagcatctggtgcggcgtgcccatggtactggccccccagcagtcggaggagggggcggtggcccggcgggctgcggagctgggggcggggctgcgcttggagcgccgcagcccggcggcaatccgggccgcggtggagcaggtgctggggcatcgggagaggtaccgccaggccatcgcgcccctggccgccggattccgggccgccggaggcgcggcccgggcagcggagaagatagaggagacgattgcgcggaaaacagaagaggcgcggccctaaaggtgcgcccccataaggaagtaatttaattgtcgcagagcggcatggctgaaaagtcatgccgtcctgccttttctttgccgttccacggtctgagcggcacccggcaggttgacttctccaatgaagttccagaccagttcgatcttctgcctgcgatggccgctggacttgtccggcgcatggacgatgatcttctttacaaactcattgacgatggtgggcgtcagttcccggatgcccacatattttcgcacaatggctgcaaagctggcaaaatcggcttgatcctgttcaaaggtttctactgcgtcccgccatgccttgacctgctccgtcagttctttttgttctgcctcatagtcggcggagagtttcaagaaccgttcatggctgatcgtaccgctgatgtcgtcctcataaatgcgtttgaaaatccggtcaagttcgccaatacgcttttccgcttgggcgatttcgcgcctgcgcttcttggcctctttttcggcttcttggaaccgttgctttttcgcggcttcctcaaatgccatggcatgccagagcttgcaaactaaagtgcgaaaaaatcttgacacgaccccgccaaatttcgagtgtttgtgttttaaaataaattctttgaacagcctaaaaagaaaaggaaccggcgtgccatttcattgcgaaataacacgccggttttttagcaaccctgtttgtcagccgttaagttagtatgattttgatacttccttatcggtgttcaccaaaagggccgcgcctcttctgtttacagagtttgagaatgaccgagatccacctcgggcatcagttcctggttgataatggtgagcatctcctccagcttggcgcactcctccggggagaaacgctgccggatgcgctcggtcacggcatggacgtagtcgttgctgatgttgtagtagtccttgtatttctgggtgacctggaggtggtactcgcgcttgtcgtgggcggactggatcttctgcacatagcccttgcggatcaggctgttgatcttataggccgcgttgggcggcgagatgcgcataaaggaggcgaactcgttgatggttgggcagcccagggcctggatggtctccatggcgaaggtttctaccgtggtcaggctggcctcgcggttctgaaagcgctcgaagatctcctgataaaaatgaagcttgaatttggtatacacgatttcaaatttctgttccaacatgccggcgcccccgcattgtcatatttttttcattttatcaaaaagcggagggaagggcaatcacaaatctttggccaaggcaaaggtaagctctgccgaaacggccagttggccgcccacggtggctttggcctcagcgacagctaccgggcccttctgctttagaatggtgcactccagctccagtacgtcgccgggggtgacctggcggcggaagcgggcgtttttgatgccgccgaacaggccgatctttcccttgttctccggcatggacagcatggtcacggcccccacctgggccagggcttcaatgatgagcacgccgggcatcacgtggtaccgggggaagtggccctggaagaagggctcgttgacggtgacgcatttgatgcccttggcccacttgcccacctcgccgtccacgatgcggtccaccagggcgaaggggtagcggtgggggatgatctcagcgatctggttggaattcaactgcatcatggctcagccctcccacttcttgaacagcacgcaggcgttgtggccgccgaagcccagagagttggacagggcatactccacctgctgctcccggccctggttggggatatagtccagatcgcaggccgggtcgggcacctggtagtggatggtggcgggcaggaagccgtcccgcaggaccagagcggtgaagatggcctccaccgcgccggcggcgcccagcatgtggccggtcatggccttggtggagctgacggccagcttggcggcgtgggcgccgaacacggccttgatggccgcggtctccccggagtcgttgaggggggtggaggtgccgtgggcgttgatgtagcccacctgctcgggggacgccccggcgtcggtcagggcctgggccatggcgcgggcgccgccctccccgttgggggcgggggcggtgatgtggtaggcgtcgcaggtggcgccgtagcccaccacctcggcatagatcttggcgccccgggccatggcgtgcccgtactcctccagcatcagcacggccgcgccctcacccatgacgaagccgctgcgctcggcgtcaaaggggatggaggcccggctggggtcatcccccacgtggagggcccgcatggaggtgaagccgccgatggacagaggggtgatggcggcctcggcgccgccgcagagcatcacctcggcgtagccgtcccggatgtggcggaaggcgtcgcccaccgcgttggagccgccggcacaggcggttaccgggcaggtgcacatgccctgaaagcccgccatgatggcaatgaagccggcgcccatgttggcgatggtggtggggatatagaagggggaggcccggtcaaagcccttctgggagcagcgcagctcctcgctctcggccatctcgatgccgcccacgccgctggagacgatgacgccgcagcgggtgagatcctccttctcccggtccagaccgctgtcggccagggcctccttggcggcggcggcggccaattgggtgtagcggctcatgtgccgcacgtccttcttgtccagcacggtggtagggtcccagtccttgacctcagcggccaggtggaccttctgggcggagcagtcataccgggtgatggggccaatgccgcacaccccgtcccggacagcctgccaggtgtcggcggcgttgtggcccagggggttgacggtgcccaggccggtaatcagcactctgcgtttttccataattgcgttcctcctcacatgcccattccgccgtccacctggagcacctggccggtgatgtatccggcctcctcggaggccaagaaggccacggcggcggccacgtcctcgggggcgccggggcggcccgccgggatggcggacagcatggcctcccgggcggcgtcgggcagggcggcggtcatgtcggtggcgatgtagccgggggccaccgcgttgacggtgacgccgcggccgcccagctccttggccagggacttggtcatgccgatgagccccgccttgctggcgcagtagttgatctggcccgggttgccccgcagggccaccacggagctgaggttgacgatgcggccgtagcgggccttcatcatgggccgagcggcggccttcatggtgaggaaggcccccttgaggttggtctcgatgaccgcgtcgaagtcctcctccttgagcatcatggccaggttgtcccgggtgatgcccgcgttgttgaccagaatgtccagggagcccagctccttcacggcggtgtcgatgagggtttttacggcggcgggatcggccacactgccctggacggcacgggtctggacgcccagggcctccagctcctttcgggtcgcctctgccgcggcggtgttgcccgcgtaggagaagaccacgttggccccccggcgggccagctccaggcagatggcgcggccgatgccgcggctgccgccggtgacgacggcggttcttccggtaaagctcatagcgttatcctttcagcgcggcggagagggcgtccaaatcggcgcaggtctccacggcgtaggtcttgatggcgggagcggtcttcttgacaaagccgatgagggccttgcccgggccgatctccacgatggtgtccacccccagctcggccaggcggcggatggtgtcctccatgtagacggaggtctgcacctgcttctccagcagggcggggatggtgtcctccggccccatctcccggcccagacagttgaagagcacggggatgcgcatcgcgccgaaggcggtctccttgaacttctcccgcagagcgtcgccggcgggggcgaggagggaggtgtggaagggcccgctgaccttcaggggcaggcagcgcttggcgcccagctccttggccagtgcggcggccttgtccacggcggcctgctcgccgccgatgaccaactggccggggcagttgtagttggcgatctccaccactcctgcgccggcggcctgccggcatgcctcctggagcttctcgcggtccaggcccagtacgacggtcatgccgcaggggcggcccgccgcggctgcggccatggccttgccgcgaaaggcggccagggaaatggcctggggagcagtgaacaccccggcgcactggagggcggagtactcgcccagggagaggcccgcggcgtagtccgggacaatgccccgctccgccagcagggcggtcatgccggcggcgaaggccaccatacagggctgggtgtactcggtcaggttcagcaccccgtcggggtcggtgaacatggtggttttcagatcgaagtccacgccggcggcgtccagcacggcgcggaaggcgggatgggcctcgtagagatcggcccccatgccggggtgctggctgccctgcccggcgtatagaaaggccagactcattcgctcagcccctttcgcacggccgcatatccggccatcagctcctcaaagatctgccgcaggggacggatctcgtgcaccataccggccacctggccggccatgaagctaccgccgtccacgtcgccgtcgaacacggccttccgcagggagcccagggtgagctgctccatctcctccagggggacatccttcttctccatgcgcagatattcccgggccatcttgtttttgagcacccgcaccggcgcgccggtggagcggccggtgacggtggtgtcgttggcgccggccttgagcacggcctgcttgtaattgacatggatggggcactcctcgctggccagcaggcaggtgcccacctggacgccgcaggccccaagggcaaaggcggcggtgagttgccggccatcagcgatgccgccggcggcgatgacggggacgctcaccgcgtccaccacctggggcaccagggccatggtggtcagctcgccgatgtggccgccgctctcgcagccctcggcgatgacgccgtcgatgccatagcgctccagccgcttggccagaatgggggcggctaccacggggaacaccttgatacccgcctctttccaggcggggacgtatttgccggggttgcccgcgccggtggtcaccacctgcaccccctcctctgccaccaccttggccagagcgtcgatgtgggggttcatcagcatcagattgacgccgaagggcttgccggtgttcgccttggcggcgcggatctcggcccgcagggcctcggcgtccatcccgccggaggcaaccaggcccagggcacccgcgttggacacggcggcggcgaaggcgccggtggcgatgttggccatgccgccctggatgatggggaactcaatccccaaaagctcgtttaatttcatagaaactccttatgaaacgcctccacgaaaaagcctcgcagagtttccccgcccgcaggcggggaaataaaatgaaatccgttttcggacgcgatatgtgcgtggacgaaaacacttctcagcccacaagtgtgagtgttatccggcgaagccggacaaaacttgcgcgcaggggctgcatctctctccaacaagcggctctgccgcttgttggaagctacgccagctccagcagagccccggcccaggtcagcccgccgccgaagcccacacacagggctttctggccggaggtgatggccccgccgcccaccagctcgtccagcagcaggggaacgctggcggcggaggtgttgccggtgcgctcgatgttgccggggcacctggccgggtcgatgcccagcttcttcacggcaaagtcgatgatgcgctggttggcctggtggaacacgaagaggtcgatgtcctccggggtaaggccggcccggtccagcacctcccgggcacagcggggcacagcctccacggcgaagcggaacaccgactggccgtccatatggacatgggggggcgcggcagtgttgacgccggggacgtagagcacctctgagttgccccggcagcccagcacggcgtggagggaggggtagtttgccccccactccaccagggcggccccggcaccgtcgccgaagagcacacaggtgctccggtcgccaaagtccatgacccggctgaggatttccgcccccagtaccaggccgtacttccggggggtggaggccagcaggcactcggcggtgtgcagagcgtacacaaagccggagcaggcggcgttcagatcaaagcatatggtatcctccggaaagcccagctccttttggagcaggcaggcggcggcgggggaaagaaaatccggggtgactgtggccaccaggcagatgccgatttcgccgggggcgacgccgccccgctccagtgcctgccgggcggcggccagacagagggaggtgtggctctcgccgtcggtgcagtagcgtcgggagcggatgccggtgcgggtggagatccactcgtcgttggtatccacgattttggccaaatcatcgttggtcacgacctttttgggcacggcggagccggtgctgattaacttaatcccgttcatgtacgctcctttctcagggccttcgcgcccatcgcgcggaattttttatagcgcccggcggccagagccggaccactgagcttgcccagggcattgagctccttgaccagggcggtgtccagagtccggaacagggcggcggggttggtgtgagcccctccctcgggctcaggaatgatgcggtcggccacctccagctccagcaggtcggcggcggtgagcttcatcacgccgcaggcctcgtcgctgcgggaggcgtccttccacaggatggcggcaaagccctccggggagaggacggagtacaccgcgttctccagcatgagcacgcggttgcctacgcccagggccagggcgccgccgctgcctccttccccggtgaccacggagactacaggcacggtgagacggctggacagggccagggtgcgggcgatggcctccgcctggccccgggcctcggcctccaggccggggtaggcgccgggggtgtcgataaaggtgatgacggggcggcggaacttctccgcctgaagcatgagccgctgggccttgcggtagccctctggtgagggcatgccgaagtggagggacaggttctcctccagggagcggcccttccggtggccgatgacggtcaccggcttgccgtggaacagggcaacgccgcccaggatgctgccgttctcggcgcacaggcggtcgccccgctgctcaaagaaatcggtaaacaggtgcttgatgaaatctgccgtgccggggcgctccgggtggcgggccagggccacccgctgggcgggggtcagcttacttgccatgcgcgtcgcccccctttccatggagcttcagcagatggagcagggtggcgcgcagcgcgtcccttggaacgatggcatccaggaagccgtgctccagcagatattcggcgctctggaagccctcggggagcttttcgccgatggtctgctcaatcacccgcgggccggcgaagccgatcagggcgccgggctcggccagcatgatgtcccccaggctggcaaagctggcggtgacgccgccggtggtggggtgggtgagcaccgagatgtagaggccgcccttctgggagaaccgctccagggcggcggaggtcttggccatctgcatcagggagaggataccctcctgcatccgggccccgccgctggcggagaaaaggatgagggggagcttgtacttgtcggcgtactccaccagccgggtgaccttctccccgacggcggcggacatgctgcccatgaaaaagcggctgtccagggcgcccacggccacccgctggcccccgatgcggccggcggcggtgaccaccgcctcgttcatgccggtgcggcggcgggcgccgtccagcttggcctcatagccggggaagtccagcgggttgttggaggccaggggggcgtccagctcccggaaggtgcccttgtccagaatgaggctcaggcggtaataggcccccacggggtagtggtgcccgcacagggggcagacatagcggtggcccaccagctcccggcggggcaccgccttgccgcaggcggggcaggcctcctcggtgtgggccggagcgggggaggaaccccgcagggccttgagggagaggagcttctgtcggcgctgtgcaaagacgctgctcatacctcacgcacctccccgctgccgctccaggccagaagtgtgtccatatgggcctctagaaagccggtggagtagttgccccggacgaagtcggggtggtggaggatctggtggagcaggtcggtgttggtggccggtccctcaatgaccagctcctccagggcccggcgcatccggcggatggcctccagccgggtgggggcatagacgatcagcttggccatcagggagtcgtagtaggggggcagctcgtagccggtatagaggccggtgtccacccgcacgccgtagccaccgggcaggtggagaaagtcgatgcggccgggacagggctggaaccccttggccgggtcctcggcgttgatgcggcactcgatggcgtggccgcggaacaggacctcctcctgggtgaccgagagggggagcccggcggaaacgcggatttgctcccgcaccaggtccaggccggtgaccagctcggtgaccgggtgctccacctggatgcgggtgttcatctcgatgaagtagaactggccgtcgggggccagcacgaactcgatggtgccggcgttgacgtagcccgcggccctggcggccgccacggccgccgcgcccatccgctcccgcagctccggggtcagggccttggagggggactcctccagcagcttctggttgcgccgctggatggagcagtcccggtcgcccaactggatcacgtgcccctgcccgtcggccatgatctggaactcgatgtggcgggggttgacgatcagcttctccaggtacatctccccgctgccgaagcaggccagcgactcgctgcgggcctcttcaaacagggggatgagctgctccggctcatacacccggcgcatcccccggcctccaccgccggcggaggccttgatgagcaccgggtatccaatggagtcggccagggccctggcctgctcggcggtgtctaccgccccgtcggagccgggcaccaccggcaccccggcgctctgcatcagcttccgggcggcggccttgttgcccatggcgcggattacgtcgccggaggggccgatgaaggtgatgccggcggcctcgcaggcgtcggcaaagtcggcgttctcactgagaaagccgtagccggggtggatggcgtcgcacccggcggcctgggccacggtgaggatggcattgacgtttaaatagctgtctgccgagcgggcggggccgatgcagtaggcctgctccgccaactggacatggagagcctccctgtccgcctgggagtagaccaccacgggctcgatctccagctcccggcaggcccggaatacccggacggcgatctcgccccggttggcaattaaaatgcgcttgaacatgggctcacccttcccggtagcggagcagcggctccccgaaggacaccagggccccgtcctcctgaaggatctcctcgatgacgcagtcgcagggggcctgcacctcgttcatcatcttcatagcctccatcagacacacggtctgaccctttttcacatggtcgcccacctgcacaaagggagcagcatcgggggcggaggcggcgtagaaggtgcccaccaggggggcggtgatgcacttgtccgcaggcgctggagcagccgccggcgacacagcggccgcgggggcgggcaccggggcggcggcaggaatgggagcggccgggccgcccttgcccagctccagggagaagtccttggtggagagcttcagggtggtggcggtgctggcgtcaaagcgggccatcagctcaaaaatctcttgattggtcataacggctcctttcggaaaaaaggcaccggcctgcaccggtgcccaggttccttattactcagcgtggtcctccaggtacttcaccaggtcgcccacagtcttcatgttgggcagctcctcgtcggcaatggtcacaccgaactcctcctccagagccatggacagctccacggcggccagggaatcggcctccagatcctccgccaggcgggcatcgggggtcaccttgtcggcgtcgcagctcagggtctccacaataatctctttaaccttctcaaaatccatgacagattctccttgcaaaattacttcaatcattttacttaaaattttttaaataaaataatttaagcatattttagcaggtcattcgcatttgtcaagaaaaaagtttgtaaaataatgggttcaattggggtgagcccttgagcggcaaggtgttttgcccgagaaaaaagttgtagggtccccttgcggaggcgggcaaattgcagtacgatagcggaaaaggaggaatcatatcgtgaaagtatttattagcgcggatattgagggaaccgctgttaccgccacacgggagggctgtcggccgggggaatttgagtatgagcgcagccggaaggagatgacggcggaggtggtggccgccgccgagggggcccgggccgccggagccgagctggtggtggtgaaggacgcccacgggccggggctcaatattctgccggaggaattgccggagtatgtccagctcatccgaagctggagcggctcaccggagatgatggtggaagggctggacagcagcttcgatgccgcctttttcgtgggctatcacaatgcggcgggggagggaggcaacgccctgagccacaccatcaacggcggcgtggttcaccgcatcaccgtcaacgggcagcccgcctcggagttcctgatctacagttggatggccgcttggtatggggttccaagcgtgctcctcacgggagacaagaccctgtgcgaggtgggggcggagctgcacccctccctggttaccgtgccggtaaaggacgacgtggggggacgttcccagggcctcagcccagttttggcccacagacggatccgggagggggcagagcgggcagtgaagcaggacttgtccgccgcccgtatcacactgccggagcatttccgggtagagctgacctataggagtcaccgggatgcctataccaagggcttctaccccggcgcggagcgggtggacgcgatgaccttggcctatgagaccggcgactggtacgaggcaaaccgtttccttctgttcgccatctgagcaatgcgccgcgtaaagcgaagggccgcccgttataaccgggcggccctttgcgtgaatgaggggtgttgttttaagtagccgccccggccggggcggcaggggcagtcagccgcggcagcagccgcagccgcaggaggagtcctcgtcctccccgcccgcagtatcccaaaggaacgcggggaaggagacatacacgggccaacgggtgttggcagccgtgccgccgccgggaaagacgggcagctcggggaaggagggcagggtggtgatcccgccgttcccggtattggaaccgttcccgcagcagcgacagcagcaattgcggttctgaccttgacaacaacacatagtaaggtacccccattcaaatttgcggcgggccttcgccccccacatcgacagtatacgccgcaggtccgccgggggtgcctggacaaacaagcgcccccggcccgcaggggccggaggcgccgttccatccgtatgttaggcggcgaccacgttgaccgcacgcagcttgtcggcattcttgggatcgggctccacatcataggtgaccttctggccctcctgaagggtcttgaagccgtcgcacacgatggcggagaagtgcacgaacacgtcgtcgccgccctcgtcgttggagatgaagccgaagcccttggtctcgttgaaccacttgacagtaccgtgatacataatggtacctcctgaaaaaaatttggagctaaatgacatagaaaaaaacccacacatttgccgctcgtctgaagatccgacgatgactacaaacatgtgagttcaggccgtgcatttagactactatacaaatataacacgaaatccaggccacgtcaagaggaaagaagcggaagggggcggcaggcgccgcccccggagggattcagagacgctccttttccggattgtcggaaatgagccgccggatggcctcgtccgggtaggacagcagccggccgtattcccaggcgagctggctgcgattgccgccgaagtaggcccgctcggccaccagattggccttgcgctccttcaggcgcaggtactggtcgaggatgtggccggcccggtagaacaggatgttgaacttgccctgattcagcgagaggggaaagaggtcggtgagcagcggggtgtcctctatgtagagctggttgccgtactggtggcagcaggagcgggcaaaggggatcagggcgtcccgctctgcggcgctgtccatgggatggctgagggccagtgccttcaccccggagcgcaccatctcgttgaagcagtcaatcacgccgcactggtaggaatagggatcaatgttctgcataatcagggcctcctgtcttgtcccctctattttaccccaccgctgcccatatgacaagcgggtaaagaaagggaaaaaaaggaagatgtgtcgattttctaccgggcccagtcccggctgcggcccaccgcccggtgccactgctccagcaggcgctcccgctgctccggcggcatggcgggggagaaggcggtgtcgcaccgccacaggcggcgcagctcgccggtaccgctccacaccccggcggccagaccggccagataggccgcccccagggcagtggtctcccggatggcgggacggcggacctcccgatccaggatgtccgcctggaactgcatgaggaaggcgtcccggctggccccgccgtcggccttgagctggcccaatggcaggccggtatccgcctccatggcgtgaaccaggtcggccacctggtaggcgatggactcctgggccgcccgggtgatgtgctcccgccgggtgccccgggtgaggcccaccagaatgccccgggcgtacatgtcccaatagggggcccccagaccggtaaaggcgggtaccagatagacgcccccgttgtcgggcaccttctgggcgtagtactccgcgtcccggctctcggggaagaagcgcagctcgtcccgcagccactggatcaccgccccgcccacgaagacggagccctccagggcgtactgcactcctccgtccagcccgaccgccacggtggtgagcaggccgttgcggctggcgcagggcttgtccccggtgttcatcagcaggaagcagccggtgccgtaggtgttcttggcgtcgccgggggagaagcagccctggccgaacagggcggcctgctggtcgccggccatgccggcgatggggatgcgcacgccctgtatgtcggtgtagccgtaaacctcgctggaggggcgcacctggggcagcatggccctgggaatgtccagggaggagaggagggtgtcatcccagtccagggcatggatgtcaaagagcatggtgcgggaggcgttggtgacgtcggtggcgtggacggccccgccagtgagcttccacagcagccaggcgtccaccgtgccgaacagaatctccccccggcgggccttttcccgggccccctccacatggtcgagcacccacttgatcttggtggcggagaagtacgcgtcgggaaccaggccagtggcggcgcggatatgctcctccaggccgtcggcccgtagccggtccaccaactccgccgtgcggcggcactgccagacgatggcgttgtagatgggccgcccggtggcccggtcccacaaaatggtggtctcacgctggttggtgatgccgatggcggcgatctccgccgggtttacccccgactgggcgatgacctccatcattaccccgtactgggaggaccagacctccatggggtcatgctccacccacccctcccgggggtagaactgggtgaactccttttgcgccacgccgagaatgttctgctcccggtcaaagaggatggcgcgggaactggtggtgccctgatccagagagagaagataggtgcccatagcgaagcctccttttagaaattgagggtgaagcggtcccgccggacggtgagcacgccctcccgctggagggcgccgatggtgcgggacagtgcgctgcggtccacgcagagatagtccgccagggcctgccggtcaaaggggacagtgacggtggcgcggcctgtccgggcggcctgctcctccagataggagagcagccgctctcggatggtgcggccggacaggtgccccagcttgcccgccagagagaggtttttctccgccagcacctggagcaggttggagatgagccgggtgtggaaggtacaggcggcggagcagggggcggagatgcggccgcagtcgatgagcagtaccgccgcgtcggcggcggccgtgacggtcaccggcaggctctccgcccgggcgcaggcgaaggactcggcaaagaggccgccggggcggatctcccccatgaccactcgctggccgtcggccttggtccggctcacctgcacctggccagtgagcaccgcccccaggtgggtggcgggatcgccggcatgaaagatcacatcccccttggagtactgccgcagccgcgcccccaggcagtccagcatggacagcagctccctgtcctccataccgtggaacagggccactctccgcagtgcccccagataggcctccatggcggcctcccttctgttgcaaaagcaacccgtttgccttatggtagcagaaaaaacggatgaaggcaagagaaagccgccgccgtcttgcaaaatggggtggaagctggtaagatagggacagatttgacagaaacggcggtgaaggtatgacaggtatgttggccgttggcgtgcttctgattgcccttggcgtggtctttctcgcggtgcctctggagcagctccagaaggtgttccggcggatgcgctcccggattggaaccaaaatcggcggcgcggtgctggtggcagccggtatcgccctggccctgtactgacatggataaggcaggccgcccgcataaattgcgggcggcctgcctgtttcacgcgggcgcagaaattgcccttgactctcacacggtggcaggcagtaggataatcctgagctcaggaagatcacatatatgtgaggaatcggccatgttgaaaatcggtaccttttccaagttgtccaggctcagcatccgcatgctgcgccgctacgacgagctggggctgctccagcccgtccacaccgacccgttcaccggctaccgctactaccgcgaggagcagctcaccacggcggggcgcatcgccgccctgcgggacatgggcttcggcctgtccgccatcgggacgctgctggaggatggcggacgggaggagctggaccgccatctggcggagcagcagcgggtgctggaggccctcctggcggagacgaggcagcggctgcgcctcctggacacggcccgtgcacagttgagaaaggatgaaagcaccatggaatacagcgttactctgaaaaatctgccccagcggcgggcggcctgcgtccgcatgaccctccccagctatgaggccgagcaccagctctggcaggtgatggcccgggagaccgcgcccttgagcctccggctggaggagccctgtctctgctccgtcacctattacgacggggagtaccgggagcgggaggtggatgcggaggcgcagaagacggtccggggagactaccccgacacggagcacgtccgcttccgcaccctgcccgccgtgacgtttgcctcggccaccttccgggggccctacgacaagatccgcgcggccaacgccgccgtggccgcctgggtgcgggacaacggctatgcctttgacggcccggccttcaatatttaccacgtcaatcccagcgagaccgacgacccggaggagtacgtcaccgaagtgtgctacccggtgaaaaagcgggcataacatttcatgcgcacaggacctgccatgaaacgatgcaaaggctcaggcgcatgaagtaattgcgcatgtgggcggtcccggcccacgcgctgtcatctcatggccatgccgcggtaagaggcccaggcttatgcctgggcctcccgctgtcagccctcgtagacctccttcgccatacgcagggcggcccaggccttgggccatcccgcgtaaaaggcggcgtgggtgagtatttccgccatctctccggcggtgacgccgtggcgtttggcgttggcaatgtgaaatttcagggagctgtccagaatgccgccggccatcagggccgtgacggtaacgatgctgcggtcgcgggcggagagagcctcctcccgtgcccacacctcgccgaagagcacgtcgtcattgagttgggcgaatttgggggcaaagctcccaagctcgtcccggcccgccgttatcttttgttccataaaagacctcctactgattatctgtcccgccggtcagtgcctccagagcccgataggccgccgcgtccaccggctcacaccactcgttttgggcgccctccccgggcacctcgacggccaggtgctgaaaggcgctgtccactgccgccccgtgccagtgcttgacattgggcgggatattcaccacgtcgccgggacggagcgcccggggagcttcgccccactcctgataccacccccgtccagcggtaacaagcagaatttgcccgccgccgcgggcggcgcggtggatgtgccagtggttgcggcagcccggcgcgaacgtgacgcagcctacgggtacctgctcggtggagagcatattcagatagctggcgccgtcaaagtaaggggcaaaggcggtgttctctgcccctgcgtggaaggggctggtgcggttgagctcttccagtgtcatggtgcaatctcctctccggccaggcggatattccacctgcggttgtttgctcctattttaagccgggccggcttgacagggaagcgccgattttgtaccatggtatcaaccaaaagtttgaacggaagggaggagcggccatgttcaacccccaattggccacctttgtctgcgtggccgactgcggcagcttcagccaggcggcggaaaaactctacctctcgtccacggcggtgatgaagcagctcaacgccctggagcggcacctggagctgaagctgctggagcgcacaaggcgggggaccgtcctgaccccagcgggagaggtcatttaccgctacgccagacagatgttcgccgactcggaacgggcgctgcgggaggcgcgggcggccgcccaggcggcccggtctgccttttgtgtgggaacctccatcctcaatccctgccggccctttatggacctgtggtaccgcttctgcgggcacttccccggctaccagctccacctcgtcccctatgaggacgaccaccaggggattttgggagagatcggcgccctgggagagaaatttgacttccttatcggtgcctgcgactcccgtcagtggctggaccgctgcaattttctccctctgggggagtatcgccactgcatcgccgtcccccggggacaccccctggcgggacggaaggggctcaccctggcagagctgcatggggagacactgatgatggtgaagcagggggactccccttcagtagaccgggtacgggccgcagtggaggcccatccgcagatccatattgaggacaccccgcagttttatgacatggaggtgttcaaccgcagcgtccagaccggccacctgctgatgagcctggactgctggacggaggtgcacccgtccctggtgacccttccggtggattggaacttcaccatcccgtacggcctgctctatcagctccggcccggcgcagatgtggcccggtttgtggccctggtccggggggacggccccgcataagaagacagcgcgcccgccggatttccggtggacgcgctgtttggccagaagggggatacgggctccgcctcatagtccggtgcggtaaagggggatgacgttgatgacgggctcctcataggggtgggcccgcttaacggccgccacggtctcctccacgcggtctgtccggcaggtgacctccaccttgagctccggcgcatggcatacctcacccatcctgcccagataaggggcggtgcccgccagggggcgccaggcgccgatgacagggctgtaggagagacagcagtcgtaccggccgatatggcccgcgtccaccgaccacagggcctgctgaacggcctccaggtggctctcagggagaaagatttccagcttgcagaactcagattccatggcccctcactcctcccggtattccggacactggtagcggggcttgccccggctggccctgccgtactcaatggctccggcaggacatccgcagatgcaggccatacagtgggtgcaccggtccccccacacagggcggccgtcccggaggcggatattgttttccacacagactgcggcgcatttgccgtagcccacgcaggcgctggtggagcggaaggggccggacttgatgacaaagcggtaaaagaaggcgttcaccggtccggatttgagcttgtcgatcgctccgcgccggacgggcgggagggactcgccccggcggatgcactccgccccctcctccagccccggcaccgcggctgccacgatagcgcgggcctcctccggcccgggagcgcggaacagggcgatgtagttctccggcatgacaaccggcagaacgccgcggtaggtgaggcccatgtcccggcaaagggcctccagccgggggatgggatcgccgatttccgccccgcaggtcatgacaaagtaggcgtcccggctgcccgaaaaccggccgccgcggagcagagcctcgaaaatgcgggggagctgccagccgtaagtgggagacacaaagacccacggggaccgggaggtgagggcgggaaagtggtcgtcccgcaggaagggaaaggcgtccaccgcctcatcccccagccggtgggccagccgtttggcgcagtagcggctgtttccggtgccgctgaaatagaaaatcatcaggagcgctccttttataaacggttatttcatttgctccaacacatccgactcccagcggtggagggccgcaagctgctccggtgtgtggaaccagtgctcaccgccctccaggacggtgagtgctccgccgaaccggcgggcgaagtcctctaccgccgtctggcggagcatggcgtccccggaggcgtacagcagggcggtgggagtgggccagcgggacaccggatgggcgcggacatactggaggtagggccaggagagggtctccccgaagggagtgtccagctcgccggccgcctccagttgggcctcgctgacgccggcccaccccatcatgtctcggatgagcccctccatgtccaccaccggggagacgaaaagcgcctgctccagacgctccccggcgaaggccagcagggagaaccaggcccccagactggtgcaccgcagggcggtatgctgccaccgccctttggcatagcccaacagcgcccgcagctcgggcgctgcgtgccaggggtccaggggcaccccgtccccgcggcgtgccccgtgctccggcaagtcggccgccagtacctgccagccccggggacaggcgagggcggcaaagtccgccgcctcctccttgcacccgcccttgccgtggacatacagccagacccggtcggcgggcggaccatagagggaggcattcagcccggccgcctccagctcagttagttccatcgcttcctcctcgtgtgcccagcagctttaccgggcaggatactctattataacacaaacctggagaaaatgcttgactttgacgctgcgtcaactgctatgctgtagaagaaggggggaatgcaggatggaatattccattcaagccctgtcgcgcctgtccggggtgaccacccgcaccctgcgctggtacgacgaaatcggtcttttgaagcccagccgggtggcggagagcgggtaccgctattacggcccggcggaggtggaccggcttcaggacatcctctattaccgggccctcggggtggagctggcccggatcaagaggtgcctggacgacccctccttcgaccggctggccgccctgcgcagccacctgaccgccctggaggcggagcgggcgcggctggagggcctgatccggtcggtacgacagaccatcggagccgaagaaaggaaggaaatcatggacgataagcagaaatttgaggcattcaaacagcgggttgtggactggcaccaggagacctatggggcagaggccagaggccgatatggtgacgccgaggtggacgaggcccagactgcggttttgaacctgaccccagagcagtaccaggagtggacgcggctgggcggggagctccagaccgcgctggaacgagcggtggcctccggcgcttctccggagggggaggacggccgggcggctgcggcgctccaccgccgctggctcaccctcaccggcaaccagtacgaccccgccaagcaccggggcctggccgagctgtatgtgtctgacccccgctttaccgcctactatgacagggctgtgcccggctgcgcccggttcttacgggacgcagtagcctgctgggcggagaggctgtgaaagggcggagcgccgcgcagctgcgcggcgctccgccttattccagctcgtccaggcggtcctggagctcgtcggccagatcctccagtgcctcgtggcgttctccccagtcctcataggcatcgctgtccataccctccggctcgagctcgtccagctgctccagcacaagctggatccgttccaggcaggagagaagttgagcgcggtccatgccgtccaactctggctgtccgggaaaggctggaaaatcaagcgtgtcccccatccgggtgcctcctttcggctctatgaagtatgacgattataccacagccgttctctcatgaaaacattgcaggcgggatttctttccgacaagcaatggaataccgaacggcggagtagacaccaaaataaaaaagatgcgtctcccaaagccgtgtgacgcaacacgttccataatcggttccgtctctttttgaagagtgcgttcactcaaaaatgctcccatgatcttcttgataacgttcccttgaatttcggtcaaaaatacagtataaacttttcgcaagtctatcataaagttctctcgtataaagcaaaagtattattgcaagtagcttcttattcagcgtgactatgatttttattgtactacattacgacggattttgccgccccaataagactatgggggttgttcccaaaacatacaagtaactttatcgaagggacgattctcatgagcagcaggcaaaaaagcatcaagccgatgtcagtaggagttcgaatcccacccattacacgttttgacctttgaatttgctctgtttgtatttgactggtggcataaggcgttttatataggaaaggccgagacttttctagcaaaaaggattttagacataaaatggccctacctgaccagaacaaggataaccatttgttctggtcaggtagggccattcaattggacccgcctaacgaggcaacgactctgacaggctttgaaagatagcccggttgtgaagaaggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgacccgggcgcaccctggccgactatctggccgatgcgggctttgactccaggcgggttgcggtagagcgcaacggggagatcgtcccaaagaggctctacggagagaccgtcctggcggatggggacaccctggaagtcgtgggctttgtggggggcggctgacatgatgcccacacgggaggagatgcaccgggcccttcaggagcggtacggcgcggagctgcaggcccggtttgacgcgggccgggtggcggtctgcggcctggggggcctgggctccaacgtggccatcgccctggcccgggccggggtgggccgcctgcacctgatcgactttgaccgggtggatttgacaaacctgaaccgccagcagtatacggtagagcagctggggcagtacaagacccaggccctggcggagacgctgcggaggattgccccttactgcgagattctgacagacaccgtccgggtgacggaggaaaatctgcctgcgctgctggagaaggacggcatcgtatgcgaggccttcgatcgaccggaggccaaggccatgctggtctccggcgtgctggagcactttccggacaagcccctggtcgccgcctccggcatggcggggctgggcagcgccaacaccatacgcaccaggcgggccttcggccgcctgtacctgtgcggcgacggcacgtcggacgtgtccggcgtgctggggctggtgtccgcccgggtggcggtgtgcgccgcccaccaggcccacatgatcctccggctcctggccggagagacggaaccgtaacgcagagaaacagaacatacacaccaaatgggaggagatatccatgcagacagtacagcacaacagcgatcccctggtgatcggcgggcacaccttcacatcccgcttcattctgggctccgggaaatactccctgaagctcatcgaggccgccgtccgggatgcgggggcggagctcatcaccctggcggtccgccgggccaacaccagggagcacgagaacattctggactacatcccccagggcgtcaccctgctgcccaacacctccggcgcccggaacgccgaggaggcggtgcgcatcgcccggctggcccgggagctgggctgcggcgattttgtgaagatcgagatcatgcgggactccaagtatctccttccggacaaccaggagaccatccgggccacggagacgctggcgaaggagggctttgtggtcatgccctacatgtatccggatctgaacacggcccgggatctggtgaacgcgggcgcggcggcggtgatgcccctggcgtcccccatcggctccaacaaggggctggccacccgggagttcatccagatcctcatcgacgagatcgacctgcccatcatcgtggatgcaggcatcggccggccctcccaggcctgcgaggccatggagatgggagcggcggccattatggccaacaccgccctggccactgcgggggatctgcccctgatggcctccgcgttccggaaggccatcgaggcggggcggcaggcctatctctccggcctgggccgggtgctggttcggggcgccgccgcctccgaccccctgaccggcttcctccgggactgagagggggcgcgggacatggaaaatcagttctttgtggactccgaatacctgagtcccgaggcgctctcccgcaagcaccaactggagaccgaccccgccagccgcacggaccacatggcctacctgcccggcatggagcgcatccagtccgacgtgatggacaaggtcatggcccagatgggcgcctacgagccggaccgatacaccgcccgggacgtggaggcggccctggcccacgagacctgctccatcgaggacttcaaggccctgctctcgccggcggcggagccctatctggagcggatggcccagcgggcccggctggagacccggaagcacttcggcaacacggtctacctcttcacccccctttacatcgccaactactgcgagaactactgcatctactgcggcttcaactgctacaaccacatcaagcgcatgaagctgaacgcggagcagatcgagcacgagatgcgggtgatcgccgactccggcatggaggaggtgctcctcctcaccggcgagagccgatccatgagcggggtggagtacatcggcgaggcctgtaagctggcccggaagtacttccgtatggtggggctggagatctaccccgtcaacagcgacgagtaccgctacctgcgggcgtgcggagccgactacgtcaccgtgtttcaggagacctatgacccggacaaatacgagaccctccacctgatgggccacaagcgggtgtggccctaccggtttgaggcccaggagcgggccatgatgggcggcatgcggggcgtgggcttctcggccctgctggggctggcggacttccgcaaggacgccctggccaccggcctgcacgtctactacctccagcgcaagtacccccacgcggagatgtccctgtcctgcccccggctgcggcccatcatcaacaacgacaggatcaacccccgggatgtccacgagcggcagctctgccaggtgctgtgcgcctaccggatcttcctgcccttcgcgggcatcaccgtctcctcccgggagagcgcggagttccgcaacggcatcgtgaagatcgccgccaccaaggtgtccgccggcgtatccaccggcatcggcgaccacgagagcaagtataccggccaggagagcggcggggccgagggggacgagcagtttgagatcaacgacggccgcagctttgccaagatgtatgatgacatgtccgccgagggccttcagcctgtgctgaacgactacctgtatgtctgatattctgtgtgtgaccagccggagcctgtgccgggaggacttcctcacccggctggagcgggttgccgccgccggccccgccggggcgatcctgcgggagaaggatctgcccccggaggactaccgcgccctggcggagcgggcgctggccctctgccgggccaggggggtgccctgcatcctccacagcttcccggagaccgcggaggcgctgggggagcgggccattcacctgccgctgcccctgctgcgcgccctcccgccggagcggcggggggccttccgggttctggggacatcctgccacagcgtggaggacgcccgggaagcggagaagctggggtgtacctacatcaccgcgggccatgtgtttgccaccgactgcaagaagggcctggcccccagggggctggacttcctccgggcggtgtgccgcgccgtggatctcccggtgtgggccatcggaggcatcaccccggagaacttcccgtccgtacgggcggccggcgccagagggggatgtgtcatgagcgggctgatgacctgtgccgacccggcggcgttgctggagcgctttgcgcggcgggactgagccaatgatgaaaagatagtggatctttgccgggcgctcatgcggcggaggcttcaacgacaaacacgccagagggacaggtgttgttgtcgtctccagcggtgatgaaaacgaatatagtgtatcttcggcccgcgccaatcaaggcgcgggcctttctatgttgaggctgcaaaacagggcagggtccctcatagactttttcaggaggtgtttttatgagcaagatgacgttaacggttcactgtgaatactcggaaacgggtcaaacgttagaaaaattgatacagagctctttctatactttcctgaaaaaggagctgtctgagccagctgtttgccgagatgtgtagtatgcctgtggcgatgaatggccgcttatctcaggaggtatagcatgtacttagagataagcaatcccatggattaccatgcagctttgtacatcagattatcaaaggaggatgagagcgagggaccatcccagagcgtccagaaccaggaatctctgctgcgggagtttgtccagcagcaccggctgagcgtctatgacacctatatagacgacggctggagcggcaccagttttgaccgcccggccttccagcggatgattgcggacatcgaggccaagaaggtcaacatggtcatcaccaaggccctctctcgactgggccgtgactacatcatgaccggccactacatggagcggtatttcccggaacatcgggtgcggtacatctccctgctggacggcatcgacaccggcgtggactccaccgccaatgatatcacccccttccgggccatcatgaatgacatgtattctattgtgaccccatggcctcatggcaaaaaggacgtctagaaaagaaccatgaatttattcgctatatcctcccgaaagggcgtcccttcactatgctgaccaaggcccaggtcgtaacgatgatgaaccatatcaacaacacagcaagggccagtctcaatggccggacaccatttgagctggcctctttgctgcttccagacactctgctgcgatggtctggtgccgctgctatcccgcatgatgaagtgctcttaaagccaaggctgttaaagatgtccctgccctgatgctgtctattaggaaaaaacttccggcttttgaatgaccctttttgaatccactgatccctggcgggcataatactggctttgcttggcgagtggaagttactcttgcacagttcctcccattcatctgcggcagcatgccctttttgcatttttcattatggggaagcacctttattgtagggtattcctaaccgcatttcaaccgtgaagccgttgatactggcactttcttttgcatgacctgcatttactcctgccggattttactttttcatttaaccgaaatatttcttttttatcacttcccttaatgcattattacttctgataagccccaaaacacgatctggataattgtcaacaattgtttgtttagcgatgtacttcgtaagtttccccttaaaattaacaatggccagagcttcttcatattttttgctttcgataatgtcttgcaacggtgtacaaagggaacattataccatatggtttgctgaactttactagcttcaaattctttccaaaataaatcaagatagtgctgattcgccttatcgcctgacataaaagtctacatctaccgaagcagctaatgcttgcatttcttgatctgtttgcatttatatttcctccaataaaacgccttattatacaatgaaaaaccatatatatgacttttttagaatttatacgcccaatgtccaccttcgcggtatttcctcaatttgcagacttcaacaaagcttgctaatatgcgatttgccgttgccgctgacaccccgcacagttcccgtacatcggcattcatgatatagtcatggtttttcaggtactcctgaatcttgttccagcggagtgtggccttatccaccttcccatcgctcatttcatcactcgtattgatggcgtccatgagcgatgctttgatagctgagagcatgaactcgataaataccgtggattctcccgcgtcattggaagcgttgatggccgcgtaatactcctgctggcggtcatggatgatggactccaccgggagccaggcaaaagtcgggttccacttggagagcagcagcgtatgccataggcggccgacgcggccgtttccatccgcaaaggggtggatcagttcgaactcgtagtggaacacgcagctgcggatcagcatgtgcacctcactggtttttacccagtccaggagttccatcaccaaatccgggacatactgcggcagagtgccaaaatgcaggacatgcccctcactgtccaccacacccacaggccgggtgcggaacatgccggactcctccaccaggcctcgggtcatgatgctatgagcagtcagcagatcgtctaccgaatagggatcgagttcctccagccgctcataaatctcgtaggcattcttgacctctgcaatatcctttggcggagccagaacctgtttgccgttcagaactgctgtcacttgctccaaggaaagggtattctgctcgatggccaaggaaccatggatggtgcggatgcggtttgttcgccgcagggtggggttcgtggacagttgcttggaagaagccaaccgaccaaccaactctgcaatctcaacaacagaattgataatagtatttgtaatttcaaaaggaggttttttgttcctcatattccacctcttatcaaaactcttttatggtattttaccataagatcgctcatttcaccaatcattatttaaacctctgattttgcagttcgcttctgcaatgatgctcacattcaagaattaaattgactttagcgtaaaatgataagacataaggccacaccaatctgcatattttaggcggaaagcttagagtaccagggggtgtggcttttctattttccctaaaattgaccagatcaaaaaatgatattttcgaggaataaacacccttatagaggtcgttttccagagttttccgtgtttccccgctgtattcccttttagcgccctatttgctctcaaatagggcgctaaaattcgaaaaaatgatatacaaaaaacagcgcgccggtttgttggttttgtcaaccatcaggccggcgctttttgttgcccggggagttcaaaaagggcattttcaatttgcgtcggagaaggatgacatagcgcgccaactttattcgtactgccaaaaagggcacacactttttcgtcccatttgctaagtggataagatggtacgataggagactcaagcgagtgactggagcgatgatcgaaaaagggcattttgcctgaaggaggaagatgcacatgaccaaagaaacctatttcgaggaactgtcctacgccctgcggcggcgggagctgctgccccggccggtggaggaggacggcctgctcccggtggagtggaacggccgcatcctgtgccgggtcacggagagcggcgccgtccggtatgaccccacctgggtggacaccagcagggcaaaggccgccctggcccaggtcacggaggcggcggggacggtgatggagtacatgacgcttctggagaatgccccacctctgaaggcggatggcctggcggacggttaccgggtgctggcagagttcaacggcacagtgctggccgggacagagacgcggctgggggcccagttcgtcacctgggcccgggactatgaccggagcggggtcaacgacggccactactacatggaggactatcagggcgccagggaggacttcgccctccgctccggcctggtggccagggaacgggtctttgaccaggagcagatggaggggctgcgccaggcggtgcagggcttcctctatggagagggccccgcctcctaccagcaggagttccaatgccggcgcctcctggatcagatcacagcccagctgccggaaagaacccaggatcagatgcagagcgaaagtcgcgagcttggacagtccatgtgagggcggcgccaaatcaggcaccgcctttttctatgcccagattttatttcatttctgcgcccacaagctgtacgccccggagcacccggcggaaccgccgcccaggccggtatgcacccgctcccccctctgcgtgggctgcccctaccccgccaacggcttcctctgctgggggagggatgggaagtgcctgcgctcagagatgcggcggctcaatgccccggacaggcaggtggcacaagaagtgaaggaggagtgatttcgcggtgaaaccaaatagcaactgcttttccctgcggccggccacctgtaaggaggccagcttattctacttagatgaccaggcggacagatcattgggtacagtgggccatgtccggatggactttggctccagcggcaaggggttttaccatacctggtggcctcacaatggggagcagttcaacacgccggagttcaaggaggccctgcagcagttcgtggacgctatgcggacggacgggccgctgagggacctgccctctatggacagattctgccgccagaacggcggggctatcacggaggacggcctgagctatgggtatctggcagagatgggcagctaccgcttctgccttcgctgtaccaccagccccggggaataccagtgctatctttactgctatgacctgcgccagcagacactggacaggccggtgggccgggtgtcctttgccaacggcgaacacatggagtttacagccccgcaggattacctccggaccatccgggaggagctgcccacaaaggatgggaccggcttcctctttgagaccctgacggatgccccggcggtgcgcaaggcggtggacgatatggtctatgacctgtatggggaggagaaccccaggccgctggaggattacgtgtctcgccaggggccggagatgggagggcagcagatgtgaccacacagaatagacagccggtgctgcgctgtgtcctgagcaacgcggcgcacccggagtatggccaagtgaccatccccttccccatccccgtcatggaatatgagtgcaccctggaatgcttggccgctatggaactgggagcccgcctgaaacgggactgccgggtggacgagctggagagcggcttccccatccttaagcggttggagggagtgagggccaacctggatgagatggactacctggcccggcggctggacagctttgacaaatatgaggctgcccagttccaggctatggcggtcaggctgggtacgtttgatatgacggactttatcaatcttaccttctgctgccagcaggccacggtaattacaaacttttcagatctagaggacatcggaaaggcgcacatcctgacgatcaacggcggctgcttgtatgcggacgagcaggaacaggtagacggcagggcggaggccctgaagttgatcctcaacgagcacggtaccgtaaccccctatgaggtggtctatgacaacggtatggagctggaacagctctacaaggagggcggccccttcccggactatcttgaccgggagttcgtcatactcctggaggcgtccgccggcgaagggcagagcactctgctgatcctgccggacagcccagccaggctggaacggctcctgtgccacaccggtatacgggacagcccccaggcacactccagggtagtggacagcaccctgcccagcggggtgatcagcagcattccatcggaacatctgtccatcaatggcctcaaccggctgtgccgggcggcggagcggattgcaccggaggatctgaaaaccctggtacaactgctggccgacaaggaccaccccagccaggggccatccctgggcgggctatccatgtgaaccgaggggagagaacatgcagaaaaaagagtttatccggcagctcaatgaactggttcccaggccggaccccgtcaccaccgaggcgctgtaccgctttgaccgggagtgtgcggagacggagtacatcgatatgctcaccgccctgcgggtggtggcgcggaatttcagtgaggagacgctccagagcgcctatgagatcatccagaaccaaaacgccgccctgcccagcgagctgttcaccgccgccgtctaccttcaggccgggcgtacaccggcagaggtgtccggtctggccagggagggccggcttatgggcttctttggcccggagcggccggaggagctcagccggattgcgacctgcaccattgtggagtctgggcgggagcaacggttttacaccatggacttcgggaggttcaacccacagcatgccttgaagcgggccataacatacagccgggaagcaggtatatccgccacccaggccatggcccgcctcaccatggatcaaccggagtttgccgaaaagcccggcgggccccgctgtatcctggacggcctgggctcagagctcaccaaggcgttgttccagctctcgccggcctgccccgccgtggccgcccatatcacctgccatgcggatttgggtatcacagagatagcttatcatcctctgtggctggagcgaagccagagtcaggcggccatccagcagatgtgaaaaaactgctggatatcacgggcacactgtggtatgttgtgtgcttaccagaagaaagggcgggaaagagctatgaaccatcagaggaaacagagcatgcgcaagaaccccgttgaaggccggcttccatttggggagctggccttttctattcagatgatacttgcggcaaaatgaagggaggcagatcatcatgcaggatgtatcgaaggagtggctggatttccggcggaatcagttccccgcgggcagccggatccagacgtgggagctggatgatcccaggaacacgctgaaggaggccagaaagctggattacatcgatgactcgggccggttccacgtccggcagagcgacggaggtgagtgcgtcctgacccttggggaggagatgttctccgtccacccgcctgagtccacccagctcaagctgtacatgcccctcaccgccagcttctatgcccggaatgagtggggagattgggatgagacgggtgaggaatgggacggcagaacgcttctggattatgaggacaggatcctgggttcatggtgtggaaccgggtgccggaggaggcggggcggggcctcatgctctggtgcgacaaggagttcctggacgtcaaggtgcgctccgccgtgtttacggcagaggccagaggcggcaggctgtggggcgtggcggagtgccaggtcgtcggccagctctctccggaggagctgacaagcctgaaggactatctcaccggccaggctgcggacggcgttggcgagggcctggagcagcaggcaatccgtgtggacggcggggagctctatgtccacctgtggcaatctgagggctggagcattcagacagagggggagcggttcgggcagacacagatccaggaaccgcacgatgacgtggtccccaccgaagcccagcacaacaggttcggtggggagaggagttccggcgaaatgagtgagccttgcccacagggcgaggcgaagggtatggagcgcggaatgacgatgggagggatgagcttgtgagtgttcccgtgctgacccaccgcagggatctgaggaaaggggatcttgtgtttccggaggagatcctgcccattggccacatgctggatgttcaactcgactgtgtcggcaaagaagttcagcaggaggtgtttggcccggagttggatcccagtccactgtgtgactggctgaacctccatactgcctatgattttgcgcttcaggatgtggtggaccatatagaaataaccctctgccggaattttggagaggaggagcacccattcacgtatccgctcaacagggcggagcgggacgtcctgcgcggggagatggaggcctgctgccagctccgtaccggtcgcacactagcacagcattacaaccatctgctggtgcaggaggaggtggagccgccggagctcacggctgggacgcgccgcatccccgtggacaaggtgagttttgcggatgagctctcagagtgcggtgggctgctccagttctatatgccggtggcctttgccccggacgcagtctttggcacccacgtggcgaccgcagaaaacgacggctggctcaacgtgtacgccgcctatgacctgaacaccggcaagccgtgctctgcactggatgttatcctggtgtgcggggacagcagcgagttcgccttccggtatccgctggccaagcaggagcaggccgcgctgctggaaaagatggacgcctactgccgggagcagaccggtatggcgttggcggatttccgggcccggtacctggtggaggaaccgcagccccgccaggctcccagtctggcccagctgtgagcacgccgtcggccccgtgtgcgccctgtgtgacgtgttcaggcggagggcgggccagggccccgcccagccagaaaactgccccgttggggccagtttcgccccggtttggggcgttcgattttagtacgaggataaagggaggtggtcgcaagcgccggcctcccgcccacaaagtcccgcagtgtggggctttcccggatttcaggctaggtggtcggaatgggagattctggccgtttggggtggtcgggttcagataaacacttactgcgccagcgggttccgctgtgtcgcaggcaaaaagcggaggtgaagaacatggaggaacacgacaacaaaaagcgcaccgccgtctggctgacacccggtgtgatccgccggatggacagctggctggaggaggacaactgcaaaacgcgcagtgaatttattgaaaaggccctgcggttctacatgggctacctggccgcggaggatacctcggagtacctctcccgcgccctggtggacaccctgcggggtacattggcagacaacgaaaatcggctgcgcactttgctgttcaagctctgcgtggaggtgaacatgatgagccacaccgttgccgcccacttccgcgctgatccggtgaaccgccgggagctgcgggcctatgcggtggacgaggtgctgcgtaccaacgggaagatcagcttcgatgatgcgctggatctccagcgccaggtctaccctgacggatgagccgcgtccggttcatgtccccctacctgaaggggggcagggatacggccaagctgaccaaccgggcccgctacatcgccacccgccccggcgtggaggtgctcaggggcgagcacagtggccagcccgccacgaagaaacagcaggcttatatccagcgtcttctgcgggacttccccggcgcggaggaattgctggaatacgaggactaccagaacgcgcccacacaggggcacgccaatgccttcatccgccaggtgcaggaggacttcgcggagcccatgagccggatggagaattacctggactaggtgtcccaccgccccggcgtgcagatggacggtgagcacggcctgtggtgcgcgagaggcaaggtgcgcaatctctcccaggccgtccggggggtggcggagcacaccggcagcgtgtggacgccagtggtggctatccggcgggaggacgcggagcggctgggctacaacgacgcggagagctggaggcagctggtgtgtgcctgcgcgccggagatcgccaggggggtacaggatcccgctggaacacctgcgctggtacgccgccttccaccgcaaggaggacagcgttcacatccacatggtagtgttttcctccaatctcaaggagggctatctcaccaaacagggcatccggcaggtgaagtccgccttcggccgacggatcttccgacaggatctgctccacatctacgaacagaaaaccgaataccgggacgccctgggccgggatgcggagcgcaccatggcagagctgattgcgcagatggagaccggccagctccaaaatgaaaacctggagcagccgattctggaactatcccgtcgcttgcagaacaccaaaggcaaaacggtgtacggctacctgccgcccacagccaaggcactggtggacgcaatcgtggatgaactggcaaaggaggaacgggtagctgccgcctatgacctgtggaaccagatgcgggaagaggtgtgccgtacctactcagaacaactgccggagcgcctgcttctttccaaacagaaagagttcaaggccgtgcgcaacatggtcgtccgggaggtgcttcagctggggcggggtgagcatcccacagcagatgagatagtacacatgcccacaccgtcgggcacaccgcctgcacaatcgggcctgccgtatggggcacatcacccacagcaggaggccgcgcaccatcagcgtacacagacacatcgggcggtatcccatgcggataccgcccgatgtgtcctccagctgttccacagcatgggccgcatcttccgggagcagtccgcctccgatgccatccagactggcctgcacatcgaccggaagcggcaccggatgctccgggagaagcgtatggccctgggacacaaggccgatgaccatgaggaaatcccccagcattctcaaagataagatgggggactgccattgaactggtagtcctccgtggtttcttccgctacttcggctccaggaatcctatgaccatatctaccgcctctgaggagatatcctccggagcacgctctacaaaggaggcatggcggctgttcagatccagcatccgggcctgatcacacaggatgaccccgtccgtcctggtacgctcatccagccggaggtggaacgggtggccccggtctgtgtgggtgatggggcaaaccatggtcaggctgctgacccggttgaacaagttgttgctgatcaccaaggcaggacggcggcccttctgctcatggccggactggggatcaaagtccagatagacgatatcaccctgttcaaaaatcgtcaccatgcctcagagccctccgccttcccccaatccagctcttcggcctcaattcggtcgatctggtcaatgggctttccgtagaatgcggtgaggcgttcctccagggtgcggtgcgggatggaagaggcacgccggatgttgataccatcatccatctgcaccagttccacccggtcgtgttctttcagaccaactgcgtccaggagggccttggggatccgcaggccctggctgttgccccatttttggatcgtcgcgtacatgaacgacacctgcctttcaaagatagtatatacagagtataaacaaaagtcaaccgtttgattcgaggtgagccagcatgggaacctatatccattttaccgatgaacagaaggagcgggccaactccgttgatctggaggaattcctgcggcagcggggggagaaactgctccgcgccgggcgggagtcccggctggccagggtgcaccatatcaccgtccggggcaacgaatggtacgaccatattgcccggcagggcggccatgcggtcagctttgtccagcactactacggcatgagctatcaggatgctatggagctcctgctaggaaaggagttgggggaggcatatcccgccgcgcagccaaagcgggaggagccgcccaagcccttcgccctgccgccgctccacaccgatatgcgccgggtgtacgcctatctaatgaaacagcgccacatcagtcgggaggtgatcacccactttgcccgggccggactgctgtacgaggatgcccaataccacaactgcgtctttgtgggcacggataagcagggcgtcccccgccacgcccataagcggagcaccaacagccagggcaagtcctttaaggtaaacgtggagggcagcaagccccagtacagcttccaccacgtggggcaggacggcctgctctatgtgttcgaggccccgattgatctgctgagcttcctcacgctgtatccggacagatggcaggagcacagctatgtagccctgtgcggcactggcggccaggccgtgtgctggatgctggagcagcatcccagcctccaatccgttgtgctctgtctggatcacgacgagcccgggcagacggcggccaggcgcctccaggaagagttacagggagcaggataccacagcggtatcctgctccctgtgcataaggactggaacgacggcctggtgcaagggcagaccatggccgaccttgcaatgaccatggggcagagtatgtaggccgcagaagcgcaccgcccgccagggggggtgtgccctgccgctggaccgggggccggttcattttggcccgcccagaaggtcatactggaagcagattgaaacgcagagagcagacaacgaagggatgattgcagtgaacaacgacacctggatgctgattctcctgctggcggtggtattcggcgccctggtcgccatcaccaccttttccggccggggcagcctggacagtatcaagagtaaaaccgtgggtgacggccagcacggtaccgcccgctgggccacaccgggggaaatcaagaagaccttccgctccgtccccttccagaccgcactgtggcggaagggggagcgcctcccgggcgcacaggggctggtgttgggctgtaccggaaagaaagggcagctcacagccctggtggattcggacgatatccactgcctcatgatcggcgcctccggcgtgggcaagaccgccttcttcctataccccaatttggaatacacctgtgccagcggcatgagcttctttgccagtgacaccaagagagatctggcccggaactatggggccatcgcccgggactgctatggctaccaggtggcggtggtggatcttcggaaccccacccgctcagatggctataacctgctcaccctgatcaaccactacatggacgtatgccggaaggagcccaccaacctggccgcccgggccaagtctgagaagtactccaagatcctgtccaagaccatcatcaacccggatggggagaactttgcacaaaatcaatatttttacgacgcggcggagggcgtgctcaccgccgtgattctgctgctagcggagtaccagatcgacggagtgctgcgagagcggaggcacatcgtatccgtgttcaagctggtgcaggagctgctggcccccagcattctgcccggcaagaatgagttccagctcctcatggaccgcttaccggaggaacacaaggccaagtggttctccggctttgccctcaccgccgccgagcagtccatggcctccgtcatgtccaccgtcctctcccggctgaacaccttcctggactcagagctggagcaagtgctgtgtttcgacagcaccatagacgccgagagctttgccgcaaagaaatccgccatcttccagatacttccgaaggaagatcagaccaaaaacttcttggctgggctgatgatcccaaccctgagtcgggagcttttctctgtggcggatgaacacgacgggaagctgcccaaccgggtggtattcttctgtgacgagctgggtaccatgcccgccttcgacatcctgcccctattctccgctggccgctcccggcggctgaccctggtgcccatcatccaaagcctggcccagttggagaagaactatggcaaggaaggggcggagatcatcatggacaatgtgcaggacaccatcttcggcggctttgcccccaacagccagaccgccgaagtgctgtccaaggctctgggcagccgcaccgtgatgagcggctccatctccagggggaagaacgaccccaaccagagcatccagatgatcgagcggcccctcatgaccccggacgagctcaagtccatccccaaggggcacttcatcgtcatgaaaacaggcacccaccccatgcgcacccgtctgcggctgttcctggagtgggggatcacctttggtgcggcctaccaggtaccccagcaggccgcccgaaaggtctactacgccagcaaggcagagctgaccgatgctatttactgggcgtttcccgcgcctgcccgccagaacaactatcgtacaccgaaaaaggagggaaccacgccatgagctattttagtgaggtctacggcgatccggagttgagcgccaaggccaggctggtgctggtgtacctccatgaccgggcaaacaaggatggcaagagctggtacgccatcgccaccatggccaaagacctgagcatctcccgctccaccataaaacgagccctggcagagttgatccaccagggccgagtggagaaacaggcaagattccgggagaacagagggtgtacttcgaactgttatcaaataaagcaattgatgcgcatctaatgtgataactcagtcagttaagatataaagtgttgtggggagaatttttgcgttttatgaaatagcccatagtattcatgaaggatttagattgagataaagtgttatacgaaacataccgccttcctgctttatatcgagcgtacccccgtatttgtctacaaccgactggacattttgtattccatatccatggaaagaatggccggagtgtagacgatgtttaccgccctcaatatacgggttggacatctcatagagaagaagattgttatggactgagatctctaatgagattttcctatgttgggctggaagggctagacatgcctctaaagcgttttcaaaagtgtttccaataataatgctaaggtcaagtatattgatgtttagagtttggggtacccagacagataaatctaatggtacagtcaaatcattagcttgctgggcatagtgttgcagaattgcgccgacttccgggttcccgacatcaacaacacttccgattttgctgagagagtcctgtgcatcaaggaacacctgttccacagacgatttatccccgcttaccgacacagctttcatggcagttaggtatttgctcatatcgtgccacatggcgcgggtttgctcctgctctttccaaaggctgtcgtaatagcttaactgtagttcaagctgttgctgtcggagatcggcattgtgccgctcttcctgccgtgctttgaccacctctgcatagacaatgattataatattgagatagaggatgcctattaaaataatcgtcgattccacagagagttttcgtcctccattttgcgtaaggcgcagaatttcatcgcagaaatagacgctgaatatctgacacgcaagaagaggcagcaagcttttcagcttcagtaaagagtgctccctgtgcatgagtggaacggcgattatgaccaacgctaattggcacactttcgctatgagaatataaatagcccgttcataccccggggacataacgtccagatactcccaccccataattgcaagcagctttaagcaaaggagctccgtaatcaaggccaacgcacaaaatacggtagcaacataaactgcattaagtggtgcagagcgataacagactttacacagcacaagaataccgagccaagtgtaaatagttcggacaatcggcataacaggaaccacgttcaaggccatgagtcctattccaaatataatataggcaacccacactatcgcagatgaacgtgagttccgggaaagtagcttttgcagatagaaaaagatgaggaatactccaaaaacaatggtagaaagatgatagatgaaatacatacaatcaccttctcaaaaagtgaaacagggcttcatcaaataatttcttccgatttctgctgatggggatctctgttccgtctgttaaaagaaggttggccttttgaatacggtctacaaaatcgaggttcaccaggaagctgttgtggggccgtgcaaagccattgccccacaaagtcccctcaaattccttgagcggagtccgcacctggtactgttctttgctggtatggattatcgttttatagctaaagacctcaatgtacgtaatgtctctgatccttacgagaattggcccgcgttccccggccacagggatgctttttggggagcacttagccactgcggcagatactgcccgcacaaagtccgggtattcgaccggctttttcaaataccgaaaggcaacctcatagccccggattatgtaggccccactctgtgtaatgaaaatgatcaacggaatatcgggcaacttgttgagttcctcagccgcctggtagccgttcataccctccatttctatatccagaagtacgatatcgaaatagtcccgccgaaaagccgcaagcagctcctccgatgaggcaaaccccttccagttcgcttgagcgttgtagcgtagcaaatagtcccggatctgccgtagttcattagggttgtcgtcgcacaacgcgaatttcatttctctccctcaacttggtcatgagtgctttttgtggaaagctgtacggatactgtcctgaataaatttctgtacaggctcgtccagttcagagagcatattttccagctcgctaaattgatattgatcttgcttctcgtcatagaaaatctgatttgcgtccagtgaaagcacattgaccagccgctttagcgtggggatgctcgccatggacaggcctcgctccaactgcccgatatagccggccgatttcccaatcaattccgcaagctgctcctgtgtcaatccgtgctcttcccgtttcatacgaattaagtcgccaatctgcatagccatcaccaatgccctcagctgtagtgttgctattattattacatagcaaatcgttggcatacagatagtgatacaatgattttatcatagttatacaaaagaaacaaccagatactgcacagaaacgacaggttacagcaaatctattgtgcattttatacaagaagttaatatatacttatcagtaaaaagaaggaatgaacaatgatcaaaaaggcggcagccggatatgtcggttggttgtgtgccaatgggattgtagcgccggaaaagaacaaaatatacgcctacgggatggagctggttctatctggcttggtcaatgtcctgtctgtcctgctgatttcaattctgatcttccatccggctgacggcttgctctttcttgtggccttcatccccctgcggacaacagcgggcggataccacgcaaattcccacctgtcctgcaatatagttttcctcagcacgtttgttgcgttggagtgcctgggacatttgcttctgaaatacggttccgtcattctctatctagctatagcagtcatttcacttgtaacactgctgatcctatcccctagcgaggcaaaaaacaagccgctgaccccggagcaacgacggcgcaatcgccgcagaagcctcattttaggcgggctgaacctggcaatcgggatcttccttatctggggccttcaagcgccggccccatggtgcacaagctattacttaggagtcatcgcagcatcaatttcgatgtgggcggctcaaataaaagaaaggatgtgtgtgcaatgaaagtgatggttgaacgtattttactgtggtttggcggggcaatggccgtgctagcgagatatacagccactgcgtcggtaagctccacctgcttctacacggcctatcagccggatgtaccagatgagctttgagatgaaaatgtagttcaattgcaaaacaaaatttagcagaaaaggggtgcacagatgaactggaactggaaaaaaatgatatctattgtgctggtagtaactgtatgtaccacagggagtgcaatcgctcaagctgttgaatgtgatgtgccgcaatatactttttcagatgaaaacatcgagattgtagaccctgctctgttttatgacctcttcacacaggagaatgatatcaatgccattcaagatgatactctagatgcttcatataaatatacatttgctccttgggaggataatgctgacaaaagcgatgtttctgtggattttgtagtcgtagtaaacggagtaccggcatacggttcggctactggtgtggttgatgcatatgatatcaacgctggcagtatcctttgggctgggcctcttaatggaagtattgatattaatgggtacaagtatcctcttattttgggattcaccaagatggagccgagtcaggaagtctgtctttcgataacgatccaatcctttgataatcatcccaatatggaaccagtttatttttcaattggtacgcccttgataacagacggtgttgaggaatatatcagaaatagacaagtagcagtaggcgcagatgatatcagtggtgttgtatctgatgatgcttttaaggcaaatgacttttatcagataggaagcgatttcggtaatttcaatggtggcctaggaggaacatctggaataggccaagaaagctttgtatatggcaatgctacaactggaacagtcatggtaactctgcgtacacatggagatcggattgataaggccttttcaggagccggggttagcaactcttttgttagtcgtcttatgattaagttaaatcgtcaagactatacagatgatagctattcatggattgtaggaattgaacagtacgattttccgagttcttcttttggaaaatctggggaattgttaatgcccctatttaatgagatacttggcgtgatgggagttccttcaaatgtgattagcagtgcactctctgggctaacaggagttgtaactaaagaaaatgcaagtacagatgcgtactatgtttcttgtgaattctctctccttgaagaagcacgctttgataagatagagactggccttccaatagtgttccaactcgaccataatagcaattatacaggatatagtgattatgcttcttccactgaaattatgtatcgtacttattttaagccccatagtgcaaacaaaggtacatactactataccagttgtgaagatacctttattcctttccaaatcacacttccagaatgaaaaagagtgctatcattattgtatggggagtcattctatgtacgagcgtttttattgtagtacatatgttatattatacgaaagtacaaatagaaacacctactctaatacacaagtcttttgaagggactatttccttctattgtgatgaaagtgactccccatacacacatattgttatcgcattggccaataggcccgataaaacagaacgatttgttgttactgaagacactatatttgccgacgattcagaaagtattattgcagagcgtatagtaggggtgcacgtagaaatagaatctgaatattggaataatgtagaatatgattactatccagttactttaatttccggatgtctttaatgtaaagactacaaaagtattcttgatgtggacaagatgaaggtggttttaatcgatctatactagtattttcgtttagaattagtaaccataaaatcttccggcgcataaaaggccgtcatctctgcacataggtattgagatggcggccaatgttattctatgcctcgctatactacccctgaatttttatttctagtgctgaaaagtcccctaaattaggggacttttttaacacaaaatcaaacgctgaacgtgacaaaggagagataatccagaagtttatggaattcagagcttcgacgaacgtccacagacgatcatttcacgccagtgattgtacttggatatcccccacacagatgcgccttttcccggttaatagagacaaattcaagtagggggtgcttttgtgtgggaagaactagtcgtaaaacgctatctttgtgcaaagacggctgggctgctgaccttggaatattatctgctgataagtctatttgcagaagatctggagatttacggtgtcaaaattgttgagtggcagaacagcaaccagcgccccggcctcacaatgagcggccagcagatctttcgcccgattgctctgctttccaaagggactgttgtgccgacaagcttggtggtggaatttatagggggctgtcgtttgcgttgccgggggacggaggaccttcaatgagcgtagaacgtggagtgtcccttactatttacatttctacttatagtttctctctgtccgaatagagtatttgcctctcatggggagctcgtgttgctgtggtctgcgactacagcaacacgggcttttctcttgattaaacaaaaccgcattgcgcattatacatagatttttacgcccagatggagcacaatgctgattttacaaaaaccagaggaaaactttttttaaccggaaaagaaccttccgctttaacctttatacttcaatcacagggcaagacgagagcggtgagaggaatgcccccgtcagagcggagaagtgaaatcctacgtctgctatgcaagcggaggcacgaaacagccataaatcttgcgacagagtttggtgtctctgagcggacgatccgcaacgatttggtgattctctcctgctattacccgatccaagttacatggggacgatatggcggagtggctcatctaccagaatggttccacctagaaaaccggatgttatctccgaaacaggaaatacttctccaaaaactgaaaacagccttagatggggaggagctccaagtcatgaatagtattctagcccagtttgccctgtattgggagtatcggtgatctaccgatttccgtcctgatccttgtaaatagaatatccggcagcgggatacgtccgctgacgagaggccctccgggaggggggctgaagcgacgctggaggatgcgccaagaccacctgtgcgggctgtgagcccgcatcaaagacggccaaggaaggtgcagagcggtgcccatctgtccacaaagtagcctgtggcgggctgtttcgcattgcggctggcttatccggcccgaccctcgtcagcaatctgataatgatactcctgtccagccacagccccgggtaaaaccgggatcaagcaatgggggcagctcggagagatcctcggagggatgagattcccgtgatgtgtgccaacacagtccgtctgctgccgcccagggcccgggaagtagtgtcgaatagggccaaccagcgaaatgtatttttgagagaattagcgggggccgttctgcggccatacgcctcataacggcccccatttgaaaatggagatatgaaatgaaccacaacattaactatatcgggatggtgaacctccttcatcacctccagaatgtcggccttgttagtcggaaggaggccgggaggaccgcggcccggctccgtgtagagaccggggcggacgtcatattttctccctgatttttgttgcgtttggatatggatattttgcggaagtgctggtattgtgtgttgctgacaggagatatagagaggcgatttcgtggacgaacagaagaaaactagtggttccctggcattgaacagcacgccccgggtgatcaccatcgcgcccagcaccccagtcagggatcgaaagctgcgggtggcggcctacgcccgggtgagctccagctcggaggatcagctcaactcctttgccgctcagaacgcccactatacagagctcatcacagccaacccggagtgggagttcgtggacgtgtacgcggacaagggcatcactggcacctcagcggagaagcgtgacgacttccaacggctcctggcgggctgccggcggggccgggtggataagatcatggtgaaatcctcctcccgatttgccaggaacgccaaggagtgcctgaaggccatccgggagctgaaggccctgggggtaggggtacggcttcgaggaacagggtatcgacacctctgaactggccggcgagcttctcaccgccatctttgccatgatggaccagaaggagagcgagaacatctcggacaacctccggtggagtatcgatatgcggatgcgcacggggaaatacaatgcctgcttcgccccgtttggataccaacttgtgggcggaaaactggagctgatccttgagcaggcgccgattatccggtatatctatgacgcctacctggcaggcaagacggcggaggacatcgcagcgacgctgaatctgttctctgatgaccgcccttggaagccacagcggatcgactacatcctcaccaatgagcggtacagcggcaatgcccttctgcggaagcgatacacgacggatactataccccgcaaagtgaagcgcaaccgtggagagaggcccatgtattttgtggcaggaatcaatgaagcagtggtttcgcaagagatattcgataaggcgcaggaactgcgcaaaaaacgatgggaaaaccgccttgtcgcccctgacatttttatatcccgccaaaacgagctggcggaacagctccgcgccgcaaagctggagaaggaacggttcctgaaggccgaggaggatcagacgatccaacagactcaggagctgattgaagccctggaggctgggccggacttcctggacgccttcgatggggagctgttccgcgagctcgtggacaagattatcgtggagagcaatgaccgtgtgcaggtacggcggcaggagcggacaacgccctgcaaaaagagcccagcccagaaggagcttcggaagctgtgcggcggcagcccaccggcctgggtggaacggcaggtactgggccttctgaaccgcctgatccagcacccggagcgcatcacctgccccgtgttggaggatgagccaccaccagaggtgacgaagctgcgccgggggctggacgagctcctgcaccgcccgccagtagacgaggttcaggccagagaactggccttccagctggcaaccctccagttaaatgccatcgggccggaagagtatgaaaccctccgccttcggaggctgtttcagggatgggcacccatggcagaactggagcaggaattgctccatgagagcgtccgccgcatcgccgtcagcaacgggacagtcaccgtcctgctaaaaaataaccagaccttggaaggaggaaattacacatgaacgataccgtgcccaatgtcatcgtcatcccagccaaagtggaaacaccccaggaacaggataaaaagcgccacctgcgggtggccgcctactgccgggtgtctacggacagcgaggagcagctctccagctatgaaaaccagctctcttactacacggagaaaatcatgaaggaaccgggctagaccatggccggggtattcgcagacgagggcatcaccggcacatccacctgcaagcggaaggagttcctgcggatgatccgccagtgcaggcaggggaagatcgacatgatcctggctaaatccgtctcccgcttcgcccgcaacaccgtggacaccctcaacttcacccgggagctgcggagcctgggtatcccagtggtcttcgaggagcagaacatcaactccatctacccggagagcgagtttctgatcaccctgcacggggctttcgcccaggccgagagcgagagcaccagtagccgggtgcgctggggcaagcgtcaggccatgaaatccggccatgtcgccatgcagtacaagcagctgctgggctatgagaagggccccgacggcaagccaaggatcgtgccggagcaggcggagaccgtccgcttcatctatgaccgctatctggccggggacagcatccgggagatcaaggcggccctggagggccagggaattcccacggtctccggaaaagcagagtggatggcatcccatatcaggagcatcctgaccaacgagaaatactgcggggacgtcctgctccagaagaccttcatccaggactgcatcagcaaaaaggtgatccccaacaccggacaactcccccaatacctgattcaaaaccaccatgagggtatcgtcagccgggagaccttcgacgctgtccagctggagatggcccggcggaacgccaaggcgggcgacatgcgaaagagcacccccaccggtcggggcaagtacagcggcaagcatgtcctcagcaacctgctgttctgcggggagtgcgggacggcctaccggcggtgcgtgtggactcagcgcggagtcaagcgccccgtatggcggtgcgtcagccgcctggactatgggaagaagttctgcacccagtcccccaccctgaacgaggaaccgctccagcaggccatcctggccgccgtcaatgccgtcatgctggatcgcgacaccctggcccggcagctcgccgccgtcatggagtgggagcttgctccgatgttgggtgagagtatgagcctggtggacattgacagggccctggaggaactgagcagccagttcaacagcctgctggccgaggcgtcagccaacccagcagaggactacacggagcggttccgggagctgtccgagtccaccacccgtctcaaagaacggaaggcacagctggagggggcctgccaggaacagggtcggctccagaaccgcctgcgggcggtctcggccgccatggagcatatgacggcggcgatgacagagtgggacgaggaggtcatccaccagctgctggagaaggtgacggtgctctcccgggagaagatccgggtgaccttccgggatggccggaagatcgagcagtatgtggcacagccaaaaaggaggaagcttgcatgaagattttcgctacaggcgatacccactggaattttgagcggtttcgtccggaatacttcccggagggccaagagctcaccaagaaagatgtggtactccagctgggagacttcggcggcgtgtggttcggggataaacgggatgacgaggccctggacaccctgctgcaaaccgaactgccggaggcggaattgtaccttgagattggcagggccatctgtgctcgcccggagaagggcgcggcggtaatggccgctgagtatctccaggccaactaccccgagtgcaggggcttctcccccagaaacctgcgccggatgagggagttctaccgagcctacgcagatagccggggactgcgggcgctggccctaaagctgggctggacgcagaatgtggccattctggagggctgtgaaggcagccaggaacgcgcatggtatctccgggccgctctggagcaccgctggaccaagtccgagctgctggaacagatccaggctggggcatggctgcaatccacactcgacgaacagacggattcctgctatactgaagaaaatacagagagtgtggagtgtctggagcatgaagaaaatcctttttgtgtgtcacggcagtatttgtcggagcccgatggccgagtatgtcatgaaagatctggtgaaaaaagcgggcctggaggccgagtttcaaatcgcctcggcggccaccagccgggaggagatcggcaacccggtctacccgccggcccggcggaagctggcggagcacggcatatcctgcgaaggccacgccgcccggcagctccgcaaccgcgactacgaggagtacgacctgctcattgggatggacaaggccaacctccacaatatgttccgcatctgcggcggcgatttcaacaacaagatgcatctcctgctggagtacgccggccgaccggatcaagaggtgatggacccctggtatacgggagactttgattccacctggcaggatgtgctggaggggtgtgagggacttttagacaatttaatgtaaaaaggttgaaccaaagtcgatgaactgattgtctgcgaagcaaaagtcggtatccaatggaaaatggaacgggacaactatgccagcctgagatattgcaaatgtaaagggtcatcaaaaaactgaacaccgttatattgctggcattaaggtttctcctacgccaaaacgttcgtacagcaaaaaagtatcgtcaatcaaaaggaaaggtatgtgctaataaaaatatttagattggagtttttcctggagcccgccggagtccatagattccggcgggtatttttttgcagttcccacactctgggaactgctggagagcatactcataatgtccctgatcaccggagttgagtcctgggctcggcaattatgcttgtactggagagtgctggttagcagtaagaagccgtgcatggctggaatgggaagacaaaaattatgcatactatggcagaaaaatagggtgacaggacgaaatattccattgtggcagcgccggttcggtgctattttgataacagcacacataaaacgggggtgatacgcagatgtggattttggaggaaggacagattttgccctatctgcgcagccattaccctgtgtttgaccaatcgggaccggttgatatccagtgcataggcgcactggaaggagaggagaagcctcgggaaccggatgaaggcgggctgatcaactatatatttcgggtttccaacgggaagcagtctgtcatcgtgaagcaggggcgttccgccagccggaagaacgacaaaatagttctgcccatatggcggaatcgtcaggaatatgagacgctccggcttcgccatgccattgtaccccagtacacgccggagacctattatgtggactgggagaacgcaatttttctgatggaggatgtgtctgatctcgctcaggttcggaagctgctctgctcgggagtcatgctacccagactggcggagcaggtgggggaatttgttgcggcgagcaccttttactgctcggagttttatctggaagcagacctgtttcgaagactttctgcacgcttccgcaacagcgatatgcggtccatcatggaagactgggtgtttctgcgggatgcaccctacctcacccataatggaaacccggtgctcaaacagcttattgaccgggatgagagtatcagggtttgctgctacgagctgcgccacaaatttatgacccggggagaggctctgatacatggggatctgcatacgtccaacgtgtttgcagacaaggagcggctcaaggttattgacatggagtatacctttgccggaccgctctgctatgatatcggatactttgcggccagcctgctgacccagtactgcacagcgtgtttccggccgttcccatcggaaggggcgcgccgtacctttctctcctatctcctctccagcctgctggagctctaccactcctttgtggagcactttacggagttttggagagaggatgcaaagccgatttatcagagatcgggcgggttttgtgagcacctagcccgtgggtttctgccggatgtgcttgggtttgcggcggtgccctgtttcccccagattacaacatctctgaccccggagttcgctcagttggacgggaaggccagaggacaggcgcatgagctctgcctggtgctcagccggtaccttctgcttgagcgggagcggtgggatacgatggaggatgcggttcaggccatcggagcggttacgcaaatttacctggattgcctggaataaacgcagcaaattaaaacacatggcgggcttgccatgtgtttttttctcaaaaaagtaattatttggataaagcggtgttgctcaaatggacttttttgttataatagagaaaaaacatggctggcgcgcaagtgggtacccacttactctaccggatatccggtagagtaagtgggtacccacttactctaccggatatccggtagagtaaaaccctttgtctgcgccgggagatggggcggaacggaaaattgagaaggaggatagaggggcatggaggacgcaagaaaattgtccgattttattgatctggacctgctgcagaacatccaggataattgctcaaaagcgatgggccttgcatttatcacggtggattacaaaggcatacccattaccaaatacagcggcttcacatctcactgcatgctggggagacaggcaaagggatttgcagagatgtgtgagcaatgcgacgcgcacggcggacttcacgccgcgatcaccggacagccgtacatttaccgctgccacgccgatctggtggatttcgcggttcctctcattgtcaatggaagctatatgggagcggtgctgggcgggcaggtgcggctacaggaggagagcgagcgggagctggagcacatcctcccacagcgtcccaattggaaacgggataaggaatgggaggaggcttaccagaagctggaggtcgtcacctatgaaaaagtggaggcatctgtaaagctgctgcgcgacatcatcgtgacatttgtggaaaggcggactggaaagggggcggatggagtcctgagagagaaggaaaagcagctctcggaggagcgggcggcccgtctggacctggaaaagcaggtacagaagcaggagagcaatacggcccgccgcaggacagagctccactacttcttttttgtcatgaacattatctcaaagttagcctatgaggagaaggcggccaaaacagaggcggtttcatacgattttgcagacatgatgcgttatgcagcgggggcagagcaaaaaatttccaccttgggggaagaactgaactatatcggggcgcttcttcggatacggaaggcttgggttcgggacaagttagcctatactatttctgtcccggagcagtatcatcaggtatcctgtccctttatggtattgcagcccattgtggagtgcgctctggagggggccgaaacggaggctgcggagcccagaaagctggatttctatgcggaggaggagaacggcaggctgctgtttcagattctcagcaatgacaccagccgctcggtggaggagctgacggaggagttatccggggcggcggaagagggatactttcatacaggcggtgtggaccgcctgttgaagcagacgctgggagggggataccgcctgatggtcaaccggcggagagacgggcgggccggtgcagcggtcagcttttacctgccgctggagcggaacggatagccggctcaagagtgctgtaaacgggaaggagctgccgcatgaagcagattctggttttgattgaaaacgagttggagcagagcattacaggggatattctgcgctccgggctgggggctgaggcggaaatcaccctcacagccggggcggagcaggccatccagcagcttcagagcggagcggtggatctcttcattgcggatgttgaacggtttgacgtggcccactgcaatatggtcaccacggcgcgaaagacggccccggacactccgatcctggttacatcggtggggacgcaggaggaaatcgcagggtatgtctggcgcctcggcgtccgggattatctgctcaagccgtaccggcccacgtggttgttggctgcggtgcgcgccttggtgcgtaaggagcgcagcggcggatgcgccgccgaccagcaggagatttacctgaggcgcctgacggagcacctgcagagattccagtataaaaagtgcaccgatgccgcaagagaataccttgatttgctctatcaaagtactgataataagggtgttatccgcacgagtgcggtccgctttgcggagggagtggcgaaagccggaatcccgttcagcaggaccacccagtggaagctgtcgggaagtctggagcactttcgggtccgctttgaccagcaggagcggaaatatgcaacctatgagtttattgtccggatgctggacacgatctttgacgccatagagaagagcgggctgtacgaggtagacagcgagcagaagattctgaattacattgaccggaatatccggcggggggtcagcctggatgaggcggcggagtacgcgaatatgagctcgtgctatttcagcaagctctttaagcggatgaccgggaaaaactatattacttatgtgacggacagccgaattgaaatggcgaagcgcatgctggtggacacggaaatgccggtcatcaatatcgcctatgagctgtcctataacgagacaaattatttcagcaaggcgttcaagaaaaaggtgggagtgacacccagcgaataccggacagcccattccgagctgttcagggagcagggggcgggctgataccggccgcgcagacgccttgcagcgccggaaagggtggagaaacatggaggaattcagcttcagcaccagaatcttttttggtgagggcgcgctggaacgcctgcgccgggtgcaggacaaaaaagttatgattgtgaccgaccgttttatggcgggcatcggtgtgccggataaggtggcggggcacctgacccggtgccaggtatctgtatttgacggcgtggtgccggacccccccatcgaggtggtggcggccggcgtccaggcccttcaggactgcggcgcggaggtcatgatcgccgtgggcggcggctccaccattgacgcggccaaggccatccgggcggtggcgaaggagactctgcacatcgacacagaccggtgggagtgctttgccgtgcccaccaccagcggtaccggctcggaggtcacggactacgccgtgatcaccgaccgggcaaagggaatcaagtatccgctggacagccaggcgctccgcccgccggtcgccattctggacccggagcttacagtttccgccccggcctcggtaacggccgacgcaggtatggatgtgttgacccacgcgctggaggcatacgtctccaagggagccaacgatttctccgacgcgctgtgtgagaaagcggtttctctggtgtttcgcttcctgccgctggcctttcaggacggcacaaacctgctggcccgggaaaagatgcacaacgcctcctgtatggcgggcctggcgttcaactcggcggggctggggctgaaccacggcatggcccacgccatcggcgccaagctccacatcgcccatggccgtatcaatgccatgctgctgccgcatatcattacgttcaacgccgacttgggacggattcggaacggcgagtacgccctcgcagcaaaaaagtatcagcgcatggcaaaggttttggacctgccggcccccagtgtgcggctgggcgtgaccaaccttctgcgggaggtggagcgcctgaaccgcaccctgaagatcccggcctccctgaaggagtggggagcggagccctccaaggtgaaggagctgcgcggggagattgtttccgctgccctggcggatgccaccaccgccaccaatcccagaccggctgcggcggagcatgtggaggctcttttgaataaggttatggggggataatcccggagcgagaagcggcaccactctatttacaaaaaagcacccgaaggggtgcttttttgcgttgtttataggaaatgcaaacaaacaggctttgaacaggtggaggacttccgacaaaaaagtatatatggcagccaagaaaacaggggagggtttccggtataatttcgccagaaagcgtgcgaatgctgtttcaggcgcgccgcggaccacaataaggaggtagtaatatgcaacaggaagccctcggaatggtagagacgaagggcctggttggcgccattgaggccgccgatgccatggtcaagtccgccaatgtcagtctggttggctacgagaagatcggttccggcttggttaccgtgatggtgcgcggcgacgtgggcgccgtcaaggcggccgtggacgccggggcctgctccgccgagaaggtgggcgaggtcgtggcccagcacgtcatccccagaccccacaccgacgttgagaagatccttccccatatggcgtaaccgacataacggaaacttaaattagagttcggagggaacatagatgaaagacgaactgatcagcaaggtcatggacgaggttatgaagaagatgggcgcgtccgacgcgacttccgcccccgccgccgcatgctgcaacaatggcagcgcgaactgcaacctgacggagtttgtgggcaccgccatcggccacaccatcggcctggtgatcgccaacgtggaccatcagatccacgagaagatggacatcgaccccaagtaccgctccatcggcatcatcggtgaccgtaccggcgccggtccccagatttttgccgctgacgaggcggtgaaggccaccaactgcgagatcgtgaagatcgagctgccccgtgataccgagggcggcgccggccacggctccctgatcatcttcggcgccgaggacgtgtccgatgcccgccgcgccgttgaggtctgcctgcgcgaggtggagcgcaccatgggcgacgtatacggcagccccgccggccacctggagttccagtacactgcccgcgccagctacgccctgaacaaggccttcggcgctcccatcggcaaggccttcggcatcaccgtcggcgctcccgccgccatcggcgtgctgctggccgataccgccgtgaaggctgccaccgtggacgtggtgggctatagctcccctgccaacggcggcaccagcttctccaacgaggtcatcctgaccttcaccggcgattccggcgccgtcaagcaggccatcatcgccgcccgcgatgtgggcatgcagatgctgaagaccctggagcccagcgtggagctcaagtccaccaccaccccctatattctgtaattgccgggaaggagtcagacagctatgaagtcaaaacgttttgaagttctggccgcccgtccggtcaatcaggacggctacgtacaggagtggcctgaggtgggcctgatcgccatgaacagccccttcgaccccaagcccagcatcaagattgagaacggcgtcatcaccgagatggacggcaagtgccgcgccgatttcgatatgctcgacaccttcatcgccgaccacgccatccgcccgggcaacgcggagaaggccatggccatggattccctggagatcgcccgcaagatcgtggacatcaacgtctcccgtgaggagatcctggacatcaccctgtccctgacccccgccaagctgaccgaggtcgtaggcaagctgaacatcgtggagatcatgatgggcatgaccaagatgcgcgcccgcatgatgcccgccaaccagtgccacgtcaccaacgtgcgcgacaacccggtccagatcgcggcggatgccgccgaggccggcgtccgcggcttcgccgagatggagaccaccgtggccgtcgcccgttacgccccctttaacgccatggccctgttcgtaggcgctcaggtgggccgccccggcgtcatgacccagtgcgccctggaggaggccaccgagctgcagctcggcatgcgcggcttcaccacctacgctgagaccatctccgtctacggcaccgagcccgtcttcatggacggcgacgacaccccctactccaaggcgttcctggccagctgctacgccagccgcggcctgaagatgcgctttacctccggcaccggctccgaggtccagatgggctatgccgagggcaagagcatgctgtacctggaggcccgctgcctggctgtcaccaagggcgccggcgtgcagggcacgcagaacggcgccgtgtcctgcatcggcgtgcccgccggcgtacccggcggcatccgcgccgtggccgctgagaacctgatcgccatgctgctggatctggagtccaccacctccaacgaccagaccttcacccactccgacctgcgccgcgtggcccgtaccgtgcctcagctcttctccggcaccgactacatctgctccggctactccgccacccccaactacgacaacatgttcgccggttccaactgggacgccgaggactacgacgactggaccatcatccagcgcgacatgaagatcgacggcggcctgcagcccgtccgcgaggaggacgtgctcaaggcccgcaacaaggccgcccgcgccctgcagggcatgttccgtgagctgggcctgcccgagatcaccgacgccgaggtggaggccgccacctatgccaacggctccaacgacatgcccgagcgcaacgtcaacgaggatctgaaggccatcgaggacatgatggcccgcaaggtgaccggcgttgacttcgtgaaggcgctggaccgcgccggcttccccgatgtggctcacaacatctacaacatgcttcgtcagaaggtggccggcgactacctgcacaccgcctccatcttcgacgagcagttccatgtgctctccgccgtcaacgtgcccaacgagtatcacgggcccatgaccggctaccagatcagcgaggagcgctggaaccagctgaagaacattcccaacgccatccgtccggaagatatctaagaggggtgaagcagtcatgacgtttgatgaaaacacgctgcgcagtgtaattgaagaggtcctgaaggagatgggcgaggtgagcggcaccgccgccgctcccgctgcggcgcctgtcgccgcggctgcgggcaagctgaccatcaccgagaatggcgaggcccggaagggcaccgccgccgacgaggtggtcatcggcctggcgcccgccttcggcaccaagcaggttaagaccattatcgacctgccacatgacaaggtgctccgcgagatcatcgccggcatcgaggaggagggcctgaagtggcgcatcatcaaggtgtaccacacctccgatgtttccttcatcgcccatgtggccgccgagtactccggctccggcatcggtatcggcatccagtccaagggcaccacagttatccaccagaaggacctgcccaacctgtccaatctggagctgttctcccaggcgcctctgatcgacctggacacctaccgcaagatcggcaagaacgccgccaagtacgccaagggcgagtcccccacgccggttcccaccaggaacgaccagatggcccgccccacctatcaggcgctgtccgccctgctccacatcaaggagactgagctggtggacaacaacaagaagccgcaggccgttacggtctcgttccagtaaaggaggcagcacgttttatggatcaggaacttttgatgaagcagatcgtggagcaggttatggccgccatgaagaacggcacgcccgcttccgcgcccgccgccgcttccagctgcggctccaaggtcaccgcggccaactatcctctggccgagagcatggccgaccagatcaagacccccaccggcaaggacttcacctctctgagctatgagaaggtcatcaacggcgagctctccgccgacgacatgcgcatcgcgcccgaaaccctggagatgcaggcccaggtggccgagtccgtccaccgcgaggcctttgccggcaacctgcgccgcgcagccgagctcatcgccgtgcccgacgaccgcctgctggagatctacaatgccctgcgtccctaccgctccaccaagcaggagctgctggacatcgccggcgagctggacggcaagtacggcgccaagaccgccgcttccctggtgcgggaggctgccgaggtttatgataagcgcggccgcctgaagaagttctaatcatactccagagtcaggaggccccagaatgaaactggtcgcaggcattgacatcggaaacgcgacaacagagacagcattggcccgcatcgaggacggtcacgcggtcttcctggccagcggaaccgtccccaccacgggcatcaaggggacccgccagaacatcaacggcatctttcactccctgaccaacgctttggagaaggccgggctggagctcaaggagctgtcggaggtgcgcctgaatgaagccgcccccgtcatcggcgatgtggccatggagaccattaccgagaccatcatcaccgagtccaccatgatcggccacaaccccgccacacccggcggaatgggcgtgggcgtgggagagacggttctcatcacggagctggaacaggctccggtcgggcgggactatattgcagtggtgcccgggacggtggactttgaggtggcggcccggctgatcaaccgggccaccgccggggaccgcaaggtcaccgcagccattgtccagcgggatgacggcgtgctgattcacaaccgcctgacctgcaagatcccgatcgtggacgaggtggcgctgattgacaaggtgcctatcggcatgcgctccgccgtggaggtggccgccgtgggcggcgtggtggaggtgctctccaacccctacggcatcgccactctgtttggcctgtcctctgacgagacccggcaggtggtgcccatcgcccgggccctgattggaaaccgctcggcggtggtgatcaagaccccggccggagacgtgaaggagcgaaaaattccggccggcacgattgagctgctgggggaaaaccgcagcgtcaaagtggatgtggacgacggggccgacaagatcatgaaggccgtggagtccattcccagcctggaggatgtgcggggagagccgggaaccaacgccggcggcatgctggagaaggtgcgccaggtcatggcgaatctgaccagccagcaccccagggacatcaagattcaggatctgctggcggtcgacacattcacaccccagaaggttcagggcggcctggccaacgagttttcccaggagaacgccgtgggcatcgccgccatggtcaaggcggaccgcctccagatggaggccatcgcccgggaatttgcccagcagatcggcgtcccggtcgaggtgggcggcgtggaggccgacatggccatccgcggcgccctcaccaccccgggcaccaacaagcccctggccattctggacatgggcgccggttcgacggacgcctccatcatcaacgccgagggacagatccactccatccacctggccggagcgggcaacatggtcacactcctgatccagtcggagatgggactgcccgactttgacacggcggaggatgtgaaaaagtaccccttggccaaggtggagagcttgttccacatccgccatgaaaacggcaccgtggagttcttccagcagccgctggatcccaacctgtttgccaaggtggtcattctcaaggagggcaagctgctccccctggagggtgactggagcatggagaagatccggctcatccggcagcaggccaagcagaaggtgttcgtcaccaacgcgatccgggccctgacccgggtcagccccaccggcaatgtccgggatattcagttcgtggtgctggtgggcggctccgcgctggacttcgaggttccgcagatggtgaccgatgcactttcccagtacaaggttgtcgcgggccgcggaaatatccgcggcaccgaaggcccccgcaacgcggtggccaccgggctggtgctctccctgacggaagggaggggctgatatgcccgtaatccaagaaaggatcaagcccaccgtccatgtccgctgtgcagaggacaccccgcaggaggtactgcggcagctccagtacggcatggaggaggagggcattccctgggaggccgcagccgggacgggcgacgccctgtccctggcctgggaggccgcccggagctcccggctggaggtgggaatcggcctggaccgacaggcgctggttctccactactccaagctggagcgcgagcagcccctgttccgtattcccgccaattccggtatggagacggtgcgggcgctgggggccaatgcggcgcggctagtgaaaaagctgccgctgaaggccctggacaggaggtgagagcatgcagcaaaaaagcctgggactcatagagacccaaggcctggcggccggcatcgaggccgccgatgcggcggtgaagtcggccaatgtggagctggtgggctatgagctgaccaaaggcggaggctggactaccatcaagatcctgggcgatgtgggcgcggtgaaggcggcggtagacgccgcgcggattgccgccggcaaggtgagccgggtggtaagcacccgggtaatcgcgcggccgtccatggggctgaccggcctgatccacaacaccgacacggtgggagatcagccgccggagccgcctgcgccgcccgctccaacggatccgccggagccgccgaagtctccggcagacgtgcagcccgcagaggagggtgcttcggggacgacggagtctccggaggaggtacagcccgttgaagtggagccttcggggacgacggagtctccggaggaggtacagcccgttgaagtggagccttcggggacggcggagtctctggaggaggtacagcccgttgaggtggagccttcggggacgacggagtctccggaggaggcgcagcccgcagaggagggcgcttcggaggcgatggagtctccgaaggaagccccctctgaaaaggcgaaggagacgccctccaaacggcgggggaagaagtccgcaaaacgctgaaccgcgcagaaaagcgggacggcagcactgatttttctgatattttctaggaggttatcacaatgggtgaagctctgggtatgatcgagacaaagggtctggtcggcgcgatcgaggcggccgatgccatgaccaagtccgccaacgttacgctgatgggctatgagaagatcggctccggcctggtcaccgtcatggtgcgcggcgatgtgggcgcggtcaaggccgcggtggacgccggcgcctgcgccgccgagaaggtgggcgagatcgtggcgcagcacgtcatcccccgtccccacaccgacgtggagaagattctgccgaagggcctgtaaaaagaggcttgaggcatggacaagaacaacgtggtttcagcagagattgtccgccagatcacccgcatggtggtggaggagctccagaagcagcagcggctggagcgctccacccccattggggtctccaaccgccatgtccatctggaccgggcggacatggacgccctgtttggtccgggcagcgagctgacggtcaaaaaaatgctcggccagccggggcagtacgcctcggaggagaccgtcaccatccgcgggcccaaaggggagctcagccgcgtgcgcgtgctggggcccctgcgcgctcagacgcaggtagagatctccatcgccgacggcttcacgctgggggtcaagcccccggtgcgcgagtccggtcagttgaaggataccccgggcattgagatcatcgggccctgtgggagtgtaaagaaggacagcggcgtgatcgcggcgctgcggcatgtgcacatgactccgaaggacgcggcgcgcttcggcgtggaggacggccagtatatccaaacggagatcgacggcctgcggggcgcgatcctctgcaatgtgctggtgcgcgtctctgacaagtacgcgctggaaatgcacattgatgtggaagaggccaatgctctgggcgtcaaaaacggcgaccgggcctttttccttgacgattgagccgggaaggaggcagggcagaggtgggccaggagctgacgcaggccaatgagacccttctggaatttgagcggctgattcaaaccggaggctgcaatgcctgggagggtacgctgcgtaccggagtggatctgggcaccgccaacatcgtgctggcggtggtggatgagcagaaccggccggtggccggggcctcttatccctccacagtggtccgggacggtatcgtggtggactacatgggggcggttcgggcggtcacacatctgaaaggacagttggaggagcgcctgggcgtcatgctggacgccggagcctgtgccatcccgcccggcatccttgagggcaatgtgaaggccatcggaaacgtcgtggaggcggcgggcttccgcctgaccaacatcgtggatgaacccacggcggcctcctccgtgctgggtatttccgacggcgcggtggtggacgtgggcggcggcaccacaggcatcagcgtcctgaaggacggaaaggtgatcttcacgggcgacgagcccacaggaggcacccacatgacactggtgctggctggcttccacggctggaatacccaggaggccgaattggccaagcgggatccggcgcaggaggccaatgtgtttcctgtgatcaagccggttgtggagaaaatggcgtccattgtccggaactacctacgggagtacccggtggaggcggtctatgtggtgggcggcgcgtgctgtttcacccaatttgaatcggtatttgagaaatttttgggtgtccccgtggtcaagccggcggctccgctgctggtgacgcccctggggattgccgtaaactgcaagctgtaaagtaggtgaggaccgttgacgacggagcaactgcgcggaatggcggacgaggcgtttgtcgagattctggcccagcgcgttgtggagaagctcctggcgcggcagaagcaggcgctggtagtctacaccggttccaacattggtgaggccgccgcgctggaggccatgggccgcctgcgcggagagggcttcacgttccgggtgctcctctcccggggggcgtccggcctgctggacgtggaacggctccgctccgttctggagccggagaagctgtgggtggagactccggaggagactccggaggcgctgaccgcccggtacgacaccattttggttccggccatgacggtacataccgccgcccacgtggccgcctgcatggcggacacaccggcgtccgccgttattctggacggcctgatgcggggaaagaacgtggtggtgaacatcgacggctgctgcccggatcacgccgagcgcctgaagcgcggcttccatatggcggagccgctgaagcaggcgcttcggaacaatctggagaccttgcgctccttcggcgcgcgcctgaccacctccggcggcctctatgacaaggcgctgcgggcggttggcggggcacaggcccggacggcggcaccggctgcgaggccggaggccgcgccccggaagcaggagggggctgcccgcatccggctggagggccgggttttgagcggacgccacgtccagggctgcccgcctcacagcaccctgtgggtgccgcgggagaccctgattacccaactggccgccgatgaggcgcgccgccgggacatctgcatccgaaaagagacgtaaagcaggtggcaaaatgtatttgggaagagtgatcgggacggtggtttccaccagcaagaacgagcatctggtggggatgaagctcctggttgtggaaaagctgacggagcgcctggagcgggaaggcaccagcgaggtggccgtggactccgtgggagcgggcaccggcgagattgtcattgtctgcaagggcagctccgcgcgctatgtgttcggcaagggtgacgccccggtggatacctccatcgtgggcattgtggatacggtagaggtgggctgatggcgaatctttacaccaaaaccggagacaagggccagactagcctggtaggcggctcccgggtgagcaagtccagcctgcgggtggagtgctacggcaccattgacgaggccaactccatgctggggctggcgtatgcccagaccgaccgggaatatatccgcaccacggttcaccgcatccagggccggctgttcgccctgggggcggaactggccagcgacgagcagggtgcggccgggctgacgggaaagatctcggaggaggacgtggcctttctggagggcgtggtggacaagtgcaccgagaccaccgggaaacagactcacttcgtcattccgggcgtggaccccgcctcggcggcgctccatgtggcccgtaccattgtccgccgggcggagcgccatgtggtggccctggcggagcacgagccggtacgcgaggtgctggcccgctacatcaaccgcctgtccgacgcggtatacgcgctggccaggcttcaagaggatctgacgcaggaggagcgcctgagggcgcaggtgactgcgctggtccggaaacagctgtccgccccggagggcggcctgcccccctttagcctggcatcgctccagaggatggcccagcgggccgtggagcgggccggacagctcggggttccggtggtgttctccgcggtggacagcggcggcaatctggtcctgctccagagaatggagggcgcgctgctgggcagcgtggacgtctcggccggaaaggcctataccgccaacgccttccagatgccgacccatgagctgggccaggcggcccggccggacggcccgctctacggcattgacgcttccgctcccggaaaaatcgtgctgttcggcggcggcttcccctatgtggtaaacggggaagtcgtgggcggcatcggcgtatccggcggtacggtggaacaggatatggacatcgcatggtacgcgatgtctctctaaggaggaacagcaaatgaacattgatgagaatgtggtcgaatccattgtgaagcgggttgtatcccagctgagcacggagaccgcttccgcccagacctgcccgtccggcggggactggggtgtatttgagagcatgaacgacgcggtggacgcggccgtggaggcccagcgggagtatctgaaccgctccatgcacgaccgggcctgctatgtccaggccatccgcgacgtggtgctggaccaggagaacctggagtacatctcccgcctggccgtggaggagaccggcatgggcggctatgagtacaagctcatcaagaaccgtctggccgcggtcaagacgcccggcatcgaggatctgaccaccgacgccatgagcggcgacgacggcctgaccctggtggagtactcgcccttcggggtgatcggctccatcacccctaccaccaaccccacggagaccatcatctgcaactccatcggcatgctggcggcggggaacgcggtggtgttcagcccccacccccgggccaagaaggtgtccctgcacctgattcagctcatcaacaaggccctctgcaaggcaggcgcgcccgccaacctggtggtcaccgtgtccgccccctcgattgagaacaccaacgccatgatgagccaccccaagatccgcatgctggtggccaccggcggccccgccatcgtcaaaacggtgctctccagcggcaagaaggccatcggcgccggcgccggcaatccccccgtcgtggtggacgagaccgccgacatcgagaaggccgccaaggatatcgtggacggctgctcctttgacaacaacctgccctgcatcgccgagaaggaagtcatcgccgtggactccgtggccgactacctgatcttcaacatgaagaagaacggtgcttacgaggtcaaggaccccgccgtgatcagccagctggtggagctggtgaccaaggagggcaagagccccaagaccgagtttgtgggcaagagcgccaagtacatcctggacaagatcggcattaccgtgggcgatgacgtgaaagtgatcctcatggaggccaaggaggaccaccccttcgtgcaggtggagctcatgatgcccatcctgcctctggtgcgggttcccgacgtggaccaggccattgagatggccgtccgggtggagcacggcaaccgccacaccgccatgatgcactcccgcaatgtggagaagctgaccaagatggccaagctcatccagaccacgatttttgtgaaaaacggcccctcttacgccggcatcggcgtaggcggcgagggctataccacgtttaccatcgccggtcccaccggagagggcctgacttcggccaaatcctttgcccggcgccgcagatgcgtgctcgccggagggatggacgtcagataaacggaggtttgggccattatgcaagagaatctgctcggcctggtggaacaggccggtgtggtgggtgccggcggcgccggatttcccacccatgtgaagctcaaggcccaggcggacaccgtcatcatcaacggagcggagtgtgaaccgctgctccgggtggatcagcagttgatggccctccaggccggcgacctgctggacgccctcgatctgctcgtggagcaggtcggggcgtcccagggcgtggtggcgctcaaggagcactaccacgcggcggtggaggcgctggagcgggagctatccaggcatcccaagctgaggattcaccggatgggcgcattttatcccgccggtgacgaacaggtgatcgtctacgaggtgaccggacgcgtggtcccggaggggggcatccccctgaatgtgggcgtggtggtcagcaatgtggagacggccctcaatgtgctggcggccgtccgccatcaggccccggtgattgagaagtatgtcacgctgaccggtgcggtgcgcacccccaagaccgtgaaggtgcccctgggcatcacagtggcggaggcgctggccctggcgggcggccccaccgtggagcactatgaggtcatcaacggcgggcccatgatggggcgtgtggtgagcaccggaagcgctattaccaagaccacaaagggactcatcgtagtcccggagggccattccctcctccagagcctgaaccggcccgtgccgcggatgctccaggatgcccgggtggcctgtatgcagtgctccctgtgctccgaggtctgcccgcggggcctgctggggcaccgcatccagccgcacaagatgatgcgcctggccgcctatggcgccctctgcgacccggagtatacccccatgaacgccttcctgtgctgcggctgccgcctgtgcgagtacgcctgcgtgatggggcttcagccctggaaactgaacgggatgctcaagggcgagatgggaaagaagggtgtccgcaatgcgctgcacaaccagccggaggcggccgcgccgttccggcagtacaagcgatacccggttcacaagctgattcaccagttggggctggacggctatgatgtccccgccccgatggaggacagctcctgcgactatcaaatggtgaccctgccgctgagccagggggtgggcgcacccgcccagcctgtggtgcgcgcaggggacagagtggagaagggagccctgattgcggcggccccagagggaaagctgggggcaaaccttcacgcgagcatcgcgggcacggtgaccgcagtgaccgagagagagattaccatccaacaataaagattggagaggaactgatttatggatatcttggctctgatcgccgcatttggcggcggcattatcggcgcttacatgggcgcccttcccgcctttattatgactggtatctacgccctggtgggcggagtcctgacggctgccggcgtgggcggcgatgttgcagtcaactacctcgcctttggttcctttgtcggcccccacatcgcctttgccggcggcgtggccgccgccggctatgcgggccgcaagggcaagctggcctccggcaccgacatcctgtcctccctcaacggcctgggtgagcccgacgtgctcctggtgggcggcatcttcggcgtgctgggcttcctgatccactactgcatcggactgctgcccgtcatcggcagcgccggccctgccaccaccgacctgcccggcatcaccgtcttcattctggcggttgtcacccgtctggccttcggcaagaccggcctgaccggcaagtacaccggctccggaaagcgcgagtggttcgccaccgggaagggcttcgtctataacgtggtactgggcggcggcatcggcattgtggtgagcttcatcgccgcgttcctgtacgagaatgagtttaccgccgcgttcagcatcttcccgatcgtgtgcttcggctttgcggcgatcacgctgatcttcacccagaccggcttcgccacgcccgcgactcaccacattttcctgccctccgggctggctgccgtggccggcatcaccgcctggggccctgcgggcgctctgctgggcgtgctcttcggcatcctgggctccctgctgggcgacttggtgggcaagagcttgaacagccactgcgacacccacatcgacccccctgctaccacgatctttatcctgacgattgtgatcaacgctgtcagcagcgtgatcaatgcctgagccaacagaggaatccataggaaaagaggccagttatgggaaagtccatcggattactggaattgaaaagcatccccgtcggcattgaaaccgccgatgcggtgctgaaggccgccaatgtggagctgctgaccgcgacccccacctgtccgggtaaatatgtcattatcatctgcggcgcggtaggcgctgtgaagagcgccatggagagcggccgccagacagcgggcatctatctggtcgggcaccacaccatcaacaacgtgcacgcttccgtcccggaggcgatcgtgggcacgtcggaggtaggacacatcgcctccatcggcgtgatcgagaccatgacggctttgactgccgttgaggcgggggactatgccgccaaggcggcgaacgtccgcctgatggagatccgcattgcccgcggcctgggcggcaagggctttgttattctcaccggcgaggtttccgcggttcgctctgcggttaaggccgcgatgaatcaactggaggagaccggggatattacaagcagcagcgtgatcgcatcgccccatccgggattgattgacaagctgacgaactaagggaaacaggaacagacgcggaaaggagggccatcagtatggcttcacaggattgtcccaactgccactatccagcacccaaccgcaaaaagcctggggagggggagcgcgtgccccagggtatgtaccacgcccccgacaggagcggtgagccggaagagtgcccccagtgcttttaccagccggaggcagtggaggaaaggccggaggaggagtgtccccagtgcttctaccagcccgaggacgggcagaagcgggaggaggccaaggaggacgactgctctcagtgcttctataagccggataaataagaattggtaagaaaggattgtgagctctgtggaacgactcattggaaagcaggcgccctatttttccatggaggcgctgtcggcggacggagaacattttgtgcgcgttgcgctgccggactatgccgggaaatggctggtgctgttcttctaccccatggacttcacctttgtctgtcccacagagctcacagccttctcagagcaccgggagaccttccgtgcggccggagcggagctgctcagcgtgagcacggacagcgtctacacccatcaggcctggcagcgcaacggcctgggcgggctgggttaccccatggcggcggatcagactctgcgggtctgcgccgattacggggtgctgctggaggaggagggggtggccctgcgtgggctgttcctgattgacccggagcaaaaagtgcgctacagcgtaatccacgacaacaacatcggccgcaatccggaggaggtgctccgggtattggccgcgctgaaaaccggcggcctgtgcgcagccggctggaaggccggggaggaaaacctccgcccggacatggcggaacgcgaggctccggtgctggcgggtacggcgcccgtgcgcatctatacgatgcccggttgcagctactgccgcagcgtaaaggagtttttgagacagggcgggatctcctatgaggagatcaacctcgcggaggataaggccgggcaggcctttatggagagccgcggctatacgggcctgccggtcacggtgatcggcgcggaggagattgtaggctataatatgcccagaatcaaggcggcgctgggcctgagcggagcaaacgaggtgaaataggatggacttaatggactttggaaccgtgcaggaggggaagatgcggcttgttcaggagatggtgcccggcaagcaggtcactctggcccatattattgcaagcccggatgagattatttatcagaagctgggcctcaatcccaatgtggactaccagcaggccgccatcggaattttgagcatgacgccctctgaaatttccgtaatcgcgggcgatattgcgaccaagacctccaaggtggagatggggtttattgaccgcttcagcggaaccctcatttttaccggacgcatttcaaacgtacaggccgcagtgtccagtatcctgacctatctgaagaatcacctggggtttaccatctgtgaaattacgaggacatgaagaaaattattttaatgggccggagcgaatgcggaaaaaccaccctcacgcaggcgctgaagggcgatgtgatccactatcacaagacacagtacataaaccattatgatgtggtgattgacacgccgggggagtatgcagaaaacgccagcctggcgaaggcgctggcgctctatacctatgaggccgacgtggtggggctgctgctgagctccaccgagccgtactcgctctacccaccctgtgtgacggcctgctgcaaccgcccggtgatcggcattgtgacccagattgaccatccggacggtgatccggaccgggcgcagggctggctggagctggcgggatgccatccgatttttcgggtcagctcctataccggggaggggatctggcagatcctcaactatctccgggagccgggagacatcctgccctgggattcggaacaggcggcggagcgtccccgggtggttctctcgaacaaatatgggaggctgcccgaagagggcggcggacacccgcaaacagtttaggaaaaaacaggagtgctcctgccgcgggagagactgcggtgggagctttgctgttatgatacgttaggcgatacaatttgcagaaggagggctgtccatggaagcgctgacctttttttccgcgatgaaccggggacagttccgggaggaacaggggattgagggcagctcttactgtatcttttttgccccgatggaggagctggtcacccaggaccgtatgaccggaagagaggaccaggtcgtgctggagctgctctatggcgatgaaatgctgcccggggccctgcgggtgaggcaggtggggagcaatgcggtcgttgaggagtccacacagggggcgtttcgcgccttcctggaggagaagccggtcaagtacatcggacaactgctgatgtacgcgcttcagttcaaaatacaggatctctccctgcgcattgagggctgcacaggcgagatgaagcagttggaggacgccctggataactgcatcgacaacagcggcacctatcgtctgctggatttccgcaggcgctacaccgagtgtgggaatatggtgctggcggtaaaggagatcctgtcgcggatcgacaagggctactatccgatgcagatgcagaacagctatgtgcttcagggcgaggtgctgctggagttccgcttcctggaggagcggtatgagctcatcaagagcacggttctcaaggactttgatacctatacctccatcatcaataacaatatcaaccggaatgcccggctgctgagcatcatctcgctggtgggggtggttctcaacttcatgttcggaagtctgctggccgccaatccacttctgggaatcatcggcggcctgtcggttgcgggcttgtctgtgggggccacggcggtctaccatgtcagccgccgcggcaatgcgccgcttccctccgggcgcggtccgcttcaggcgtttccctccctgccgaaattccacaggaaagagaagcgggagcgggatcagtgggaaaaatgaatatggagcggtgacagagagggtgtgccgaacccgtgccgccaaagaccggaatgggccggagaggacgaatgtcctctccggcccattttggtttcactaggaagcagatgttccgggttgccgccgtttttccggcggcctcagtccatcacctcgccgccgggcgcatcatgggcgtcggaccagactcgctcaagagcggcccaatcgcgctccgtcagcctgccggtccactcctccgtgtcttccccttctgtccagatatagtcatgggagttggtggcctcctgcatggctgcgtagtaccaggcggaggtattgttgtccggccaggtgagcatctctccgcggggcagcaggtgtgcttcatgaggggcccggcccagggtgcggttgacgatggtgcacgcctcggcccgggtgatattgtccagcgggtggaaggtgccgtcgggcatgccctcaattagtccgtactccaccgctgcggccaggaaggtcacataccactcggttccctccacatcggagaatcggccgtcgtatgtcaagtccccttcggtaaactcgaaaaagctcactgcaattttggtaaattcagaccgtgtgatgggttcggtagggcggaaggtgccgtccggatagccgtccagaatacccatgctggtcaaggtggatatggcgttgttgtaccagtcgccggaggccacgtcggagtatggattggtctgactccaataggcctctctggcctcgtcggtgagcaggcggaaaaagatagtggccacctcgctgcgggcgatatcgccctccggccgcacagtgccgtccgtatagccgatgatgtaggccacgtggtcctcggtattcagagactcaggctcgtcgtcgcggtccgggcggtgagaggggcggccggggtcggggcggctggtgtgaatggtgtaggacacggttggcctgcggaagttctccggctggccgggccggctgttgctgtccaccgggtacagggtcgcgctgttgttggtgtaaaggccgctgtagttctcgctgccgtccgcatcgtactggccgtaagtcccctcggcagtctggggattcgtcagcttcacggtgtaggtcaactgaacaggggcaaagttggagacggggacgttgatctcccacacaaagcactcgtcggacgcaccgtcctggcctttggcgtagtatttgagcacaaagtaataggctgattcgtccgcgtttgccgcgtcgttgaagccgaagccataggcgctggtgatatagggatcattaaacgaaggatcaatcaattcggtcttgtcgagaacctctccgtccacggtcagggccagccggtctatgtcgttgacaaaatcaaagtcgtacccgttgcttttgttgtcggtgccggagccaatttcatccaccacatagctgcctttatcaagtaggtagtagatgtcgttctggatgtcggtaaaatcaacggtttcgccgccggccaggtagtccatgaaactgatgccaaagccataactgtcgacaccgctctcagctttcagcgcataacaatggtactctttgctcatttcctgatagagcgcattactattgtagagagacagatcaacgttgattggatagccgttcctatttacataagggatggagccttcagaatccaaatcacttgtttttggacgattcggatcgttcaaagaatattcatatttggtgtattcactatccaatacgccgtttactgcatcaaagtagctggcccaattttccaggacataatcagaggaatacttacattcccacgcggacaatccgtcatttggctgttcgttccttccgcccgttccggtatcaccgccgtttctggaagaaattgtgtatgcctgatcgtagtttccgcctttgcaataataatacgttaaaccatcactgacaaggattaaatatttccgagagctatcaacacttgtatctgcatccagcattgccttgccagccagcagtccggcgtgcatattggttccactctttagtgtctgctggatcgcggcttcaatgtccgcatattcggtagccagatcaaagaattcaccattattggcgacattggcaaccgcattaaaaataactacaccgacattgatcttcgcgccagtgttctcaagctgatcctttagggaacgaagcatctccagagacttggcctcaaccgttgcactcgtagatttgtccaatacaaagaccacatctgtaacgagctgttcctctgccgcgggcagggacagggtcacgtcggactcaaaattgctgtccagattggttgcggtcttggatttggaggtgtcccatccggtttcttcgccgggctccagagggctcaggccatgggctgctttcagcgccgtaagtccggttgcagaggcaaacccggtcagcggctcaaaatccgtgaactccaccgcgtgatagggctcctcatgcgcctcccagcgggcgccctcgctgtcgtcgtaccagccgtctatggcgtcgatgcagtctccctcccctccgtcaagggtccagccggagcccacttttccgaaggagagagagggcccgctgacaccttcggaaacatagatatcatcgcctgcaacaagtgcatgattgttgcagattatggcatcggcgggcagaattacagtcgggtcatagttatcgccatagccgacataaattccgccgccgtagccatccagaaggctgtgcgaaaccttgttgccggtgatcttgaggacagccccgtcctctaccgtcagattgccttgccgcacatacagtccggtgttgttgttatcctcaatataaagctcgctggtactgtccactgtgaatggatagtcgttgtagagccgtacagcggcataaccatagctggaattcccggcgtttccggtcacagtaacaatggaaccgctctcgacggtaaaggcgttgtttacggtaatccccataccgttgttattttttgtgttgacggtggagttatcgatactcagttcaccggcagaaaggccatgggaaccgttgttgttgaaattgacttcggaatcctcgataataaagtgagagccattggagccatttccaaggctgttgacaacatccaccttagaattggtaatcgtggcatagaatgtacccgtgaagccggagcggttgtggtcggagatgaaggtagaattagtgatattgacgttatacccgccatcaccgccgtcccactccagagcgtcgttcgggtagtttttaatcgtcaggacagagccgtttgtcagattcagcttattgttgctacagaagtaaatcgcatggggggaaccggtgctaccggttgcatccatggtcatattgacgttgtccagcgcgagaacggcatctttgctggcgcagatcgtcatccaggtccattctccatacggtgtggaaccaaccccgttcatgacaacatcgatgcccttaaaggtcagtgtcttgccccacagggcaatgccgtccttttcaaaggttacggtcggcttttccgccagattcggggccgacgtaatggtaagactcttggttaaattccatcccttggtcgtggcatcggccagaagttcgatggttgcaccgtcctccgctgcattcaccgcctcgtccagcgtggggtactcgttttcctcaattttcgctacattgtcatccgagaggagagtggttgattgattcgagggcgcgtcctcggccgccagggcgctcacgggcaacatgctgaggcacagggccagcacacagaacaaacccgtgaatcgcttcaaaattcttcgcatacttatcctccttttttcaaatatgctgggactctattgttcaaaaagacctgctgcaatcacctcgctttgtatggcaaaataaatcttttgtcctaggttcacctgtgtattccggcaggatgcggcataaagggcgataaaaaaagccccgtgccgaggcacggggctaaaaatgggcgcagaagatgggccggtgaagcataattgcttgccccggtctgcttttccatgtccaaaacaggctgcacttcttgaaagagagcaaaagatgtggtaaaatgaataccgttctatgtactgaacatttgcttttcaagccgtatataggacaaaagatttattttgccgctatgatatcagccccagacgggcaagctggcgggcgtgctccgcgccggtggagagcaggtagatccgggtggtctcgatggaggagtggcccagtacatcggccagcttgaccacatcccggctggcctggtagaaggctctggcaaacaggtggcgcaggttatggggaaacaccttgctgtctgccactccggccttccggcacaccgctttcatctccgcccacacctgctttctggatatgcctctgccgcttctggtgagaaagatctcgccggaggcgattttttgtgcccgcccgtattgcagcagcttgcggcacagcttaccggggatcaggattgtgcggattttccccttcagcgacacctccgcccggccgcggcgggcggcctccatggtcaggtatttcacctcactcacccggattccggtggcgcagatggcctccatgcgcaggcccagacgctcccgacccagtccccgggcggtggagagcaggcggccgtactcggcccggctcagctcccggtcgggggagcggaaaagccgccgctggagccgcagtggcttgaccgtgcagtccatccagcccaggaaacgaaaaaaacggttcagcccggccagcttgctgttaactgtggcaggggagaggccccggcgcagcagctcggccttccagccgcccgccgaaccggcggccacggtctccggcgccagccaggcggcaaactgacgcaccgaccgcgtgtactgtttgatggtctctgtgcagcgctcctctgcccggagcgcctgggcgaatgcagccagcgtttccacggtaatgcttcgcagttccatatggttctgccccccattgaatcaaatattttttattttacccaactacgcgggatgatatgaagtagcggaggcgggttcgggagaagggggggccgctgccgcgggaattgtgtgccggaacattttatggtatagttgtaaaatagaaaaaacaggtgtgccggcggagcgctccggaggagagcaggctggcgcgtgatttccggcgaggtgatacctgtgatagggaaatggctcaactacatgtccagactgcacgatggtgtggatgcgattctgatcgcagaccggcatgggaccatcgaatactccgccatgttctccgagcaggaaaacgggctggccgacgagggctttatcgggaagaatatcctcgaagcctatccgcaactgaccgaggagacctccagccacttccgggtcatgcggacgggggcgccggtgctcaatgaaaagcaggaattgacggacttttatggccggcggaccatcttggtcagctccacctttccgctggagtacagcggcgagctgattgggacgatggagacctcggttttctaccacaaggacgctcagttggatgggaaaaaccactggctggccaatccgcacaaggggctgttccggctggacgacatcattacccaaaacccggagatgctgacgctcaaggataccgttcagcgggtggcggccaacacctctcccgtgctcatttggggagagaccggcacggggaaggaactctttgcccagtcactccatagccacagctccagggccagggggccgtttgtggcgcaaaactgcgcggccatcccaaccaccttgctggagagcaccctgttcggcactacgcgtgggagctataccggggcggaaaaccggaaaggactgctgaaacaggctgatggaggcactctgttcctggacgaagtgaactccatggatctgtccctccaggccaagattctcaaggcgattgaggagaagcggttccgccctgtgggcggggaacaggatgtgcacagcgatgtgcgtattgtttccgccatgaatgtggatcctatcaccgcagtacgggaggggctgctgcggcgtgacctgttctaccggctgggtgtggtgcagttggcgctgccgcccctgcggaagcggccggaggacattccgctgctcaccgatttctatgtggagcagtacaaccggaacatggggcgggcgatctccggcgtgagcgagctggtgcgcaatgccctgctggcctatgactggccgggcaatgtacgggagctgcgcaatgcggtggagtcggcgttcaacctctgtaccggggccacggtacagctcaatgatattccccgctatatcttttaccacgaggaggaggcgggggagaggcaggagccgtggcctatgccggaacatatggggcttcaggaggcggtccgccgctacgagaaggggttgattgtccgtgcgctggagcagagccggacggttacggaggccgcggagaagctgaggctgacccggcaggcacttcaatacaagatgatgaagtaccatctcaacggataggactgtagaaagcaagaatttttgtattttgcgcaaaaattcttgctttctttttgccgggcctgtcccgcgaggcggccgcgttccgcgcaacccctggcagtgcaggcagttctaactatgtttgcctcttttgacaagctggcatccggcttgcttattctaggggcagtggttatgcgtggaccacatatctgaagttaggagagggttaaagatgacaccaaagaaaaaaggtatccgtatcccccacatgttcacgctgctcctgctcatcatcgcggtatgtaccattctgacctatgtgattcccgcgggccagtacgaaacctacgtggatgagaacggcgtggagatgctggtggacggcagctaccaccgcatcgagcagaccccggtgaccccgatgaaggctttgatggccgtacaggagggcctgatcgaaaccgcttatatttcctcctttatcttcatcattggcggcgccttcggagttgtggcggagaccaaggccattgaggcgggcatcggacgcatcatcaagaaaacctccaaacggcaggagctgctgatccccatcatgatctttgtggtgggcttcggcgccggctccttcggcatgtttgaggagtgcctggtcttcatccccttcctggtacccatctgtatcgctatgggctacgactccatcaccggcctggcggtggccatcgtgggcagctccagcggctacgcaggctcctttgtccaggccgccaacgtgggggtttcccagagcatcgcgggcctgcccatgtactcggccatgtggtaccgcctcatcatcctggtggtcatgctgaccatcgcggcggtgtatatctatttgtatgcccagcgcatcaagcgggacccaacccgcagcctgatgtacgagttcgaccgccagcgggaggagaaggtggatctgaacgatcttccggagctgacgggcacccggaagctggtcctgctggtcatgggcgccaccttcgccctgctgatcgtgggcgtgctcaagtggggctggtatatcaacgagctttctgccctgttcctgggcatgggcatcgtcgtgggctttgtggcccgggtgggcttcgacggctttggccgcctgttcagccgcggcgtggccgacttcgcggccggcgcgctggcggtgggctttgcccgcggcatcctcatcgtgctggagggcggcaacattctccacaccatcctgtacggcgcctccggcctgctgacctcgctgccctcctctctgacagtgctgggtatgtacgtattccaaaacttccttaacctcctgattccctcggccagcgggcaggcggccacctctctgcccatcctgctccccatgggcgacatggccgacattacccgacagaccacctgcatcatcttccagatcggcaatggcctgtccaacatcctggtgcccacctcgggcaccttcatggtggccctgaccatggcaaaggttccctacggcaagtgggccaagtggtttattcccctgctgggcctccagttcgcggcgggcgcggtgttggtgctgatcgccaacgccatccgcctcgggccaatgtgagcagaaagaaggtatttcgatgaaagagacaatacaaacagcggcggagagcttcctccccgcgctctgggccatgtcccgtgcgatgtacgaccaccctgagctggggctggaggaggtcaactcctcccgcatgctgcgggagtggctggcggagcagggcttcaaggtggaggagaacttccacggcctgcccaccgccttccgggcagtctacggctccggcaggccggtgctgggcttcctgtgcgagtacgatgcgctgcccgaggtgggccacggctgcggccacgacctcattggcgtcgtctcggcgggagctgcggctgtcctgcggcagacggtggacgccgtcggcggcaccctgattgtctacggtacgcccgacgaggaggtcacctgtaccaaagtacagctcaccgacgaaggggcctttgacgagctggatgtggccctcatgctacacccctatcaaaagacctgcggccggatggggagcatcggcatctatccggtgcagtacgagtttttcggaaagaagtgccatgccaacgaggccgggccgggcagcgactgcatcaacgccctggacgccgccgttgccgcctacctcagcgtcaaccaggtcaagcagtatctggacgccaacatctacggtatcctcaacagcggcggcaccctgcccaacatcatccccgactatgccagcctgcgctactacatccgctgtgaccaggagtggaagacccgtcgggcggtggagcgcatcaaccgctgtgtccagggggcggcggacagcatgggggcggagctgaagatcacccagtacctgtgtcccacccagccgctgctgctcaacgagccgctgctggatgcctatgaaacgaacatggccgcgctgggtgagccggtcgtggtggaggaggccaaccgcctatctaccgacgcgggcaacgtgagcttccggatacccaccctccacgggatgctcggcattcacggatgtgggggtgtcgatctgcatacggaggagttcgccgcccgaaccgtgaccgaggagggccgggaggccacccggctgggggtctgtgccctggcgggcgtgggatacgacctgctcacccggcctgagctgctggaggctgtccgggccgacttccagcggggcatccgggaacaggacgagaaaggagtttcatcatcatgctattgaaaaattctatcacggaggacaagactatctgggctggcctgaaccacccggagctccccctggaggaggccgacatagctgtgttcggtatcccctacgacggcggggtcagcttccgctccggcacttgtgaggcgccccaggagctgcggaaaatcacccacaccatctcgcccaccaccgaggatttccgggatatctcccctgtgaaggtcaaggatctgggtgactgcgtggggaaggaccgggacgagatgttcgccgaggcggaggagctggcctatcaggccgtgaaggcgggaaagttctttaccatgatcggcggcgaccactcggtgacgatccccgtccaccggggcgtcaaccgggcggtggaggaggacttcggtatcatccacatcgacgcccacttcgatctctgccacgagatgcacggggacattctgtcccacggctccaccgagcggcgggccaccgagctgtcccacgtgggggacagtgaccacctctacttcctcggcatccgctccatcgagtccgacgagctggagttctaccagaacaacaagatcaacgtcctctccgccgctgatgtggaccacctgggggtgccggcggcactggagcggatggtgtcccacatgaagcggttctccaaagtctacatcactctggatattgactgcctggaccccgcctatgccgccggtaccggcacgccccaattcggcggcctcaccgcccggcagctcctggacctgctgaagggcctttttgacggcctcaacatcatcggcatggacgtggtggaggtggcccccagactggacccctctctggcggcgctgttcgcggcccggaaaattattaccgagtgctgggcccaccactacttcaaaaacctcgcccgtgcgtaagcagagagaagaagaccaagcgcataaaacacggcctccggttcaggcggaggccgtgttttatgcgctcagaaaaacttttcagaccgttcatccgtccaatgtttaacagccactgcggcggtatacgtttggatgaggtgagcttaatgaagcgaataggtgcgctgctgctctgcggtattctgctgctcccggccgccggagcttccggcaccccttggccggcctgggcagccgaggcgctggcatggggacgggaaaagtcggtcagccgggcatttctggcctcgccgggacagcgtttgacccgcggagcggtggcccggctgctctatgagtcggcagggcagcccgctgcgcatgaggagtgccctttctctgatgtgtctgaaaaggatgccgcagccgtgggctgggcagcagggcagggctatctcactggcgtgggagatggaacctatgagccaggccgccctgtcacccggcaggaatttgccgctatcctctggagacaggcgggaacacccgaggtaccggtccaaggactcgagcgttttggggatgccggcactgtgtcggaatgggcgagggatgctgtgctctggtgccagcaggccggggtaatggcaggccggagcggggataaactggccccagaggataccatcaccacagcggaggcgctggtcatgctggagcgggccgccgggctgcccgatgtcgggcagctccgggacgatctggagatccttgccgcacaccaccggccggtgggctcccagggggaggccgatgcagtccggtatctgagggaccgctttgaggaaatggggtacagcgtcactctccagccctataccgacggccagggccgcaccgggcacaatgtcgccgcggtaaaggcggcctctgttcccgatgcggatatcttggtgctgtccgcccatcacgacagtgtgcccactgcctatggggcaaatgataatgcctcgggtgtggttgccctgctctatacggcggaggcgctgaggaatgtaccgactgatacggaggtgcgcttcctcagcttcaccgatgaagagaacggtaagaatggatcccggacctacaccgcctctctgacagaggaggagcggactcggatagtcggtgcgatccagttcgatatgctgggcgggctcggttccacagggactctggtgtgtactgtagacggggaggcgaactgggtcagcgacctgcttcagaaaaagaatccggggttggagagcggagtggagaccgccagcgaccatacctcgtttcagctctccggaatacctgctgtcctgctgatgcagagggggcggggctacctgtaccactcggcggcggatacggcggaacagttggatctgtatgccattgcggctgccgctgacagcgcagcagccgcggcggaggagatctgctcggccgataccccctcctaccgggctctggcccgggagcagggagagagaagcgcctaccgccagaccagacagaatatgatctatttcggcagttccagagcggatactgaggcgtacatcggagcggcgggagagcccgtaggcgccagtgagatatccggggaggggtggaccgacacctatgagacctaccactactccatgcgctggtttgacagcaaagttcctatgagtacctattaccagtaccgcaacggttttctagagcgcattgagctgcggccggaggaaaccggctatacagaggaacaggtacgggaactcattgaggcgatgtatggctcccccgtatcagaggaggggggacagaccgactggtccgaccccatttacagcaaatatatcacgctgtcccgtgacgaggaggggtgtctcgtcacggtgggaaattactccgtgggcatcaccaatgtgctggcctcctatctggtgagcggcggtcaagccgtcatcagcgatccggaggatgcggcggtatggaactatctgtgttcgatcctcccgctggaggccagacagaagctggccgagttcaacctgtttacggacggtaccagtaatgtcctggcctatacctctcccattcgggaggagggcgttacggacaacacccgcttttccatcagcattgactacttcgatgtgtatgatgaaaacggggagaagcgggactggagcaaactgacctacacgattttgcacgagtatggccacgtcctgctggaggacgagacacaggtagacctgaccgtgggcagggacactcatgacccggcgggatttgtggagggggccttccgcagagcgttttacgatgcgttttggagggagcttggtgtcagcggcgcgggtgattacgacagatcgcctactcactatgtgagccgttacggggccaactacttccatgaggatatcgccgacacctttgccgtctttgtgttgggtggggagcctggaaaaaacactgtggcagaggagaagctgcgctttttctggagggacccagatatgacggcgctgcggtccgctgtccgggaaaacctggggttggagtggccgaagcgagctgacaccagcagctccagccccacgccgccggtggccgctgctctggaggaattggaacagaagctgatggaagcgattgtagcggtggagcagccgcccgccttagcatgtgcggcaccggtcggttcggcggagctgtccatggctgttaaaaacctgtactacagcatcttatccgaccatccggagtacaagtatgcctatgatctcacttcagaggtaggggaggacggactgctccgctgtaaagtgtcctatatgccctaccgtaccggcgcgtatcccgccggatttcagggaatagaggtggatggcctggatcgtctggtggaggtggcgcggggtggactgtcacaggagagtattcccatccggattaccgagcccactctgacagtggatgccatgaaccgggcgcttcagcaggtgggcggaggttggctgttgtgccagctcagccgtgacggcaccgctatcacggtcacgccccagggtggcctgagccgagaggaggccctgaaccggctggctcagtcagagtgcctggcaaggcaggtttatgaggaaatcgtcacggcggagatggggaaggctgcacaggctgaggcgctgtatgcttacttgacggaacaggtacgttacgacttccgttactacagccagcccggtgagatgccctacagcgctaccaccgcatacggggcgctccatgaccatctagccatctgcggcggctatgcccaggcgttccagatgcttttacaacaggcggagattccctgtattaccgtcagtgggaagatgggtggagagaaccacatgtgggttctggcccaggtggacggccagtggctctattttgatcccaccagcgaccggggcagggttgattacggttttcagtacttcggagtgggagaggatgctctgttccgctatacctgggaccgggagggggcgcgcagtttaacggaggcgctgtttccctaatcgggaaaattggaaaacggcattgacgcatacccctgtatacgtcaatgccgttttcggctgcccggcgaatcatcgtcatggcctcggcgcagatgataggcatcgcattgggcaggcgaaagaagcgtgtggcggtttcggcttggatgatgttgtccagagcgcgtactgcgctgccccatcagccgggctgagggcttgtctcccgaagggatcagcgcatgcctgctgtgcaatatgcagatatgcggaatcaccattttgacttccccactgggacagtgctctccgccggactctatattgatcacatccggggcaaaacgcagccaaatttctgattttgggtatgcaaattaagaccgagacgtttgctctatcccggcccctgtccttctgcatcctggcagtcctcccaatccgggagacgaaataggcggttgaggacggcccgcgtctgccgagagagtcaagctgctatggctcaaagcgccgtgcccctcttggggacggacaggcgggagagctccacgccctcgtgctccagcagccggagcttggcggcgatgccgccggcatacccggtgaggctgccgccggagcccacgacccggtggcagggaatgatgatggagatggggttatggcccaccgcgccgcccactgcctggctggacatggagggctttcccatctgcgccgccagcgcccgggcaagagctccgtaggtcgtggtttctccgtagggtatttggcacagcagcctccatacccgctgccggaactccccgccgatggggcacaggggcagttcggagggcatcggcttttctccagcaaaataccgggccagccagtcccgcgccgcgtcaaagacgggaagcccgtcccgctcctccagcacctcccgcacggctccgccgaaatacttctgtccctccagccaaaggccgatcaggtgctccccatcgctgcccagcgtgagcatccccagcggggatgggcagaccgcagaatagtacatccaattcctcctttttgatcaatcagatggatttcacagcggcaccgcaggccgcctgtcaatgagatcatagcacaaaacgcaccaattttctcctatgaacgttccaagccaacaaaagggggttgacaggagcggggaatatgtgtattattacactaacgctttaattcgttagcgagatagaaggtgattcaatgtcgcagtttctaaacggggctctccggcggctcaccccctatacgccgggggaacagccccggaatcaggcatacatcaagctgaacaccaatgaatctccctatcccccgtcgccgggggtactggcggcgctgaaccgggcggagggggagaacctgcgcctctactccgacccggaagcggtggagctgagggaggcgctggcggcccggtacggggtggagcgtgagaatgtgtttgtcgccaacggctccgacgaggccctcagcttcgcctttctggcctatgccgccgacggccgtggggtggcctttcccgacatcagctacgggttttacgccgtgttcgcccgcctgtacggcataccagtccggcaggtgcccctgcgggcggacttccgcctggcgccggaggactacaatcacctgcatcgaaccattgtgctcgccaaccccaacgcccccaccggcctggccctgagtcgggacgaggtagaggggattgtccgggccaacccggatgcggtggtggtggtggacgaggcctatgtggacttcggcggggagagcgcggtgcccctcaccgcccgctatcccaacctgctggtggtgcagaccttttccaagtcccgctccatggcgggagcccggctgggctacgccatcggggatgcggccctgattcaggatctggaggccatccgcttctccaccaatccctacaacgtcaaccgcctgaccctgcgggcaggggccgcggccctggcggagcaggactactacgacgccaactgcgcggccatcgtggacacccgcgccgataccaagcggcggctggaggcgcttggcttcacctgcaccgactccagggcgaacttcctctttgcccgccatccggcagcggacggcggggacctctaccggaggctcaaggagcgcggggtgctggtgcgccgcttcgacgccccccgcatcggggactatatccgcatcaccatcggtaccagggcccagatggacgccctgctggaacggctggagggactgctatgagaaccgcccacattgcgcgcaagaccaatgagaccgacatcaccctcaccatttgtctggacggccggggggtgagcgccattcagagcggtgtgggctttcttgaccacatgctcaccctgctggcccgccacgggcggctggatctggagctcacctgccggggagacactcaggtggacgaccaccacagcgtggaggatatcggcatcgctctgggggacgccgtggcccaggccctgggggaaaagcggggggtgcgccggtacgcctcactctacctgcccatggacgaggcgctgattctgtgcgcggtggatctgtccggccgggggggctattacgatgccctggacatcccggcccagaagatcgggcgcttcgacaccgagctggtgtacgagttcatgaacgccttcgccgtccacgccggcctcaccctccacctgcggagggtgtgcggccgcaactcccaccacatcgtggagggggccttcaaggccctgggccgggccctgcgggaggcggcggccattgatccagagggccgggacgaaattccatccacaaaggggatgctttgaccatgcaggagcggctgaaccggctctatgagcagtacggctaccgaaaattcaaaatgtcccggtttgaggattacgacctctacgcccagaaccgggattttctgcggcaagaccgcattatcacctttaccgacgccgacggcgccctcaaggccctcaagccggacatcaccctgtccatcatgaagagcaacggaggagacagcgaaaaggtgtactacaacgagaacgtctgccgggaggtggggggcgccttccgggagatcctccaggtgggggtggagtcggtggggcagattgacccctatgccgaggcagaggtcatcgccttggccgcccgctccctggagcagctctccccgaagtacgtgctggctctgtccgacgtgagcttcgtgggcagcctgctggaccagatggggctgtccgcccccgtgcgggggaaggtgctgggcctcgttgcccgaaagaacgtcccaggcttgtgcgtcctggcggagcggggggagctgaccggggagcaggctgacggcctgcgggagctggtggagctgtacgcccctctcaaggaggggattggccgggtggggcggctggccaagagcaacgccgcctgggagaccctgcggcagctctccctcaccgccggactgctggagtcgtttggactggaggagcgggtacggctggatttctccctggtgaacagcatggattactacaatggggtgatcttccagggctttctgcccggcctccacaccccggtgctctccggcgggcggtacgacaacctgccccgtaagatgggcaagcaggtgggggccatcggctttgccctgtccatgggcttgctggaggaaagggcggacggcggacggtttgacgccgacgtgctgctcacctatgggcccgacgcggagctagccgggctggcagcctttgccgaggccctgcgggcctccggccgctccgtccgctgtgagcgggcggggggctccgcccagctccgctgtcggactgagctgcgctaccgcagcggcatgacaccggaggaggtgggactatgatcaatgtggcgctgcccaaggggcggctgggggagagggcctacgaggcctttgcctccgccgggtacgactgccccgcgattttggagaaaaaccgcaggctgacctttgaaaacagggagaagggagtgcggtatttctgggtgaagccctccgacgtgagcatctatgtggagcggggggcggccgacgtgggggtggccggccgggatatcctgctggagtacgagcccgacgtgtacgagctgctggatctgggcatcggccggtgccgtatgtgcgtggccgggccagaaaacttctacgacgcgcccggccgaaccctccgggtggccaccaaattcccccacatcacggcggagcactacacggccaagtcccgcgacatcgacatcatcaagctcaacggctccatcgagctggctcccatcctgggcctgtccgacgtgattgtggacattgtggagacgggcaagaccctgctggaaaaccacctggcgcctttggagaccattgtggacatcagcgcgtggctgatcagcagccgggtgagctatcaattcaagcatcaggagatcgccgcgatgcaggcggccctggcgcggaagctgtgaggcggtcatgatcaaaatatatgatatggaaacgctggaggagcgggagatcctgttccgcggcggaagcggggcggacgtatccgccccggtggcggagatcctccgggccgtgcaggagcggggggacgcggccctgcgggagtataccctccgctttgacggcgcagcgccggacgccctggcggtgacggcggaggaggtggaccaggcggcggcgcaggtggagccggccttcctggccgtgctggaggaggccgcggagcacatccgggcctaccacgcccggcagaagcgggagagcttcgtgatgaccgagcgggagggcgtggtgctgggccagcggatcatccccttggcgcgggtgggcatctatgtgcccggcggcaccgccgcctacccttccaccgtgctgatgaatgccattcccgcccggatcgccggagtgggggagatcattatggtgacgccgcccgggcgggatggggcggtgaacccccacatcctggccgcagccaaaatcgccggcgtgacccggatctacaaggtgggcggcgcccaggcggtggccgccctggcctacggcaccgggaccatccctcaggtggataagatcgtgggccccggaaacgcctacgtggcggaggccaagcgccaggtcttcggccgggtaaacatcgacatgatcgccgggccctccgaggtgctggtactggccgacggccgctccaatcccgcctgggtggcggcggatctgctgagccaggcggagcacgaccggatggccgccgccgtgctggtcactgactcccgccccctggccgaggcggtggctcatgagctggagcggcagttggccgccctgccccgggcagagatcgcccgggcctccctggaggccaacggcaagctcatcgtctgccgggatctccgggagggcatcgcggtggccaaccgcatcgccccggagcacctggagctgtgtgtggacaaccccttcgactacctgggggagattcagaacgccggctccgtcttcctgggccgttataacccggagcccatgggggactactttgccgggcccaaccacactctgcctaccatgggcaccgcccggttctacagtcccctgtcggtggatgacttcgtaaagaagtcccagttcagctactatacccgggacgccctggccagggactaccggaaggtgagcctgttcgcccgcaaggagggcctggacgcccacgccagggcggtggatatccggtttgaggggggagaggcatgatcgccatcatcgactacggggtgggtaacctgttctccctcaagagctccctggcggccatcggccgggaggccgtggtcaccggggaccgagcggtcctccgggcggccagccacgtgatcctccccggcgtgggggctttcggcgacgcagcggcccggctgcgggccgccggcatggcggaggcggtactggaggccgctgccgcaggcaagcccgtcctgggcatctgcctggggatgcagctcctcctggagcgctcctttgagtacggggagcaccccggcctgggcctcattccgggggaggtgcgccccatccgggacgtgattccggcggggctggccgtgccccacatgggctggaacgccctccgcttcccggcggagcggccccgcagccccattttcgcggctctggaggagggggagcacgtctatttcgtccactcctacgcgggctttgcctgcggagaggggctcaccgcctggaccgagtacggcgcgcctctgacggcggcggtgcagagaggaaacgtgtacggcacccagttccacccggagaagagcggggatgtgggactgcggattctcaaggcattctgcggattggagggttgaagcatgattctgcttccggctattgatctctatgagggaaaggtggtccgcctgaccaggggggactacagccggatgacggtctaccgggaggaccctctggaccaggcgagggagtttgagatcgccggggcggcctggctccacaccgtggatctggagggggccagggacggaaccacccccaatttccgggtggtagcggagctgtgccggtccaccggcctacaggtggaggtgggaggcggcatccgcacgctggaggccgtggcccgctacctggacgcgggggcggcgcgggtgatcctgggcactgccgccgtcaccgaccccgtttttctccggaccgcactggaccgcttcggagatcgggtggcggtgggggtggatctgaaggacggggccatcgctatcaaaggctggcgggagaccgccccagagccggcggaggccttcttccagcgcctggtggactggggggtgcggaccgtcatctgcaccgatgtctcccgggacggtatgctgggggggaccaacgtggcgctgtaccagtccctggcggagcggcttcccctgcaactcatcgcctccggcggcgtgtcctccctggaggagctgaggcggctgaaggcgctgggcctgtacggcgcgattctgggcaaggccctttacaccggggccctgtcgctgcgcggcgccctgggggaggtggagtgacatggtgaccaagcgtatcatcccctgcctggacgtacgggacggacgggtggcaaagggagtcaattttcaggggctccgggacgtgtccgacccggtggctctggcggagcactactcccgctccggtgccgacgagctggtgttctacgacatcactgcgtcccatgaggggcggaagctctttaccgatattctgaccaaggtggcctccgccattttcatccccctcaccgtggggggcggcatccgggggctggacgacttcgagcgggtgctggcctgcggggcggacaaggtttcggtcaactccggggctgtccggaaccccgctctcatcggggaggcggccaggcggtacggcgaccagtgcgtggtgctgtcggtggacgtgaagcgggtggacgggagctaccacgtatttctgaacggcggccgggtggacaccggactggacgccctggagtgggtgcgccggggagtggacgccggggccggcgaggtggtggtcaactccatggacaccgacggggtgaagggcggcttcgatgtggagctgctgaaggccgtaagccgggcggtgtccgtgccggtggtggcctccggcggcgcagggagcgccgccgacttcgcggccctgttccgcgccctgccggagctgtccgccgggctggcggccagcattttccacttcggcgaggtgaccatacctgcgctgaagcgggtactggcggaggaaggggtgtgcgtgcggctgtgattgatgtgcagacgctgaaatttgacgagaaggggctcatacccgccattgtgcaggatgcggagacggggagggtgctcaccctggcctacatgaaccggcagtccctggccatttccctggaaaagggcctgacctgcttctggtcccgttcccggcaggagctgtggcttaagggggaaaccagcggcaattaccagcacattgtggagctgcgggccgactgtgaccgggacgccctcctgatccgggtgcggaaggaggggccggcctgccacctgggcaccgactcctgcttcgacggagcggtattctttgcaagggaggagagatgacatggacgagcagttcagctatgaggggctctaccgcctgctggaggagcgccgggccaagcggccggagggctcctataccacctacctgtttgaaaagggcctggacaagattttgaaaaaggtgggcgaggagtgcaccgaggttatcatcgcggccaaggaccgggatcacaaggagacggtctatgagctggcggatctggcgtaccatgttctggtgctgatggtggaggcggggatctccctggacgaggtgagggccgagctggccggccgccacgtcatcgaccacaaggtgaagcaggagaagatggcctccgaccaggcggagtgaggagaatttgcacacagagcgaaggagcccctggagccgcaaagcggctccaggggctccggttcatttgtaccggcccaactgccagaaggccacggcgctggccgccgccacgttaagggaatccacgccgcgggccatggggatgcaaactgtatagtcgcagtgggccaccgttcggggggaaaggccgtccccctcggtgcccaggacgatggccagcttttctgcggacaccagccgggagtcctcgatggagagggcttcgaggctcagggccatggcggcggtctgaaagcccagggcccgcagacgggcaagtcccggctggggccagtcggcggagcgcgccccgatataggtccacgggatctggaacacggtgcccatgctgacccgcaccgcccggcgatggagggggtcgcagcaggtgggagtgaccagcaccccgtccatgtggagggctgccgccgagcggaagatggcccccacgttggtggggtccacgatgccctccagcacggccacccgcctggcgccggcgcacagttcctccacggcgggcagggaggggcggcgcatagcgcacagtaccccgcgggtcagctcgtagcccgtcagggcggccagggtgtcccggccggcagtgtagaggggcacgtccccgcagcgggcgaggatgtcccgggcggggccctccagttggcggcgctccatcagcagggaaacgggctcatatccggcgtccagggcgtggccgatgactttggggctctccgcgatgaacagggccctctccggcgcgcggcggctgcggagctgggcctcggtcaggcgggcgaatacgtccagttcgggggcggagaggtcggtgatctcgatgatgtggggcatggtgtccacctcgattattcttgcttgccttcattataccgccgtccgggcggaagggcaacggaaaacagccgcgccgcctcccaacatgggaggcggcgcgtgggttacaggagcatcccggcaaagcactggcaggccaggaataggatgccggcggtgaccaggggggccagccgtccggatgggccggaggcgaggcgctcccgcagggaggtaaacaggaaggttagagcgccgaaggccgcgccgcctaccacagcaaagcgcacggcctctgtcccggcggtgagcccggcggcccaggggagcaggccgaaggtgagggcgcccagcaggagagtaagcccccagttccggcggggaacgcccttggagagataggcctctgcggccagggccagcagggagcaggccgccgccgcgggcaggcccacggcagggagcacggcggcggacaggaagacgcggtagagaaccgccgccaggcagcccaagcccaccacggcggccagggcggtattcagggtatatttctcttgcatggcttaacctccccactcggttgcgctggagctgacgtccgcgccggtgacaaaggcggaggcggagttgaccgccttgaccaccgccttggaggtgacggtggcgccggtgagggcgtccacgttgtcccctacggccagctcgccccggctccagatgagctgggagagaaagcctgcgtcggacagggcttccgccccaaggccgaaggtctcctccatctcccgcaccaccgcacccaccacggcgccgtcaaagtccacggccaccagcatggtgatatctccggcgtagccggcggtgacggtctcgacaatatagccggtggaaccccggtggacagcggcgatggcggtgtcctcaccgttgtaggcctcctcggtgaagggagcgccgccggggagaagggtgtcgaagagcctggcctgttcggctgcggcgttctccgccgccgtgggggccagtcccgccgaaagggccaacaggagcacaaagacggcggccaacacggccacgggcttgatcagggctttcacattcatccggcctttcctcctctcacagcgccgaagcgcaccggcggcagggccttgtccagcgcccaggcgcaggcgttcatcagcagaatggcgtaggtgaccccctccggatagagcccgaagtagcggaacagcacggtcagcgcgccgcaccccacgccgtaaaccaattgggccgcgggcagggcgggggaggtggcgtagtcggtggccatgaacagggcgcccagcatcacaccgccgcccagcaggctgtagagcatccaggcaacggggtcctcccccttataaaataccagggtgaggaaggctacagtacctaggtaggcggcggggatacgccaggagatgaccttccgcccaagcaggatggcaccgccgatcagcagggccagggcggaaacctctccgatgcagccgccaatgttccccaggagcatgtcggccggggaggccgcgggcagggcgggcatcaccatgtcgtggagaggggtggcggcgctcaccacatcggcggtggagccgaagaggggcagctccgccccggcgggggcgtagcgtaccagccaggcgggccacagcagcatcaggaaggcccgggcggccagcgcggggttgaagatgttctggcccaggccgccggacaggcccttgaccactacaatggcgaatacgccgcccaccgccgccagccagtagggggcagtggcggggagggtgagggccagcagcagcccggtgacggcggcggagccgtccgcaatcgagccgggggacttggtgacggcccggaaggcccactcggaggccacgcaggaggccacgctcaccaaggttagcagcagggcccggagaccgaagaaccataccccggccgccagggtgggcagcagggcgaggagcaccgtgcccatcagacggcgggtggtctccccgctgcggatgtggggggaggaggatgtgatcagcttcacggacgaattccctcctttaaggcttgtttcgccgcccggaaccgctccgtcagggggagctggccgggacaggtgtaggagcagcagccgcactcgatgcagtcggtgacgtggagggcctggagggcgtccagattcccggcggcctcgtagcgatagaggtacaggggctgcaggtgcatggggcagacctccacacacttggagcagcggatacacaccggacgctccggtgtgggattggcgctggtgaggcagagcaccgcgttggtacccttgagcaccggggcggccagttcaccctgggccgtacccatcatgggaccaccggagagcaccttacaggcgtcctccgtgaggccgcctgcggcctcgatgacctgggcaaagggggtgccgatgcggacaatcaggtttttgggctcctttacgccctcgccggtgacggtgacgatgcgcttggttaccggcttgccctcgtacaccgcccggtagacggcggccacggtgcctgcgttaaacacggcacagcccacagagaagggcagatggcccggcggcacctgccggccggtaacggcctggataagctgtttctccgccccctgggggtagcgggtgggcaggacggccagctccactcccggccagtcgggcaggtgcctgcgcaggatggcgatggcctccgacttgttgtcctccacggcgatcacccgccggtcgggatggagagcggcatccagcgcagccagtccccggaaaatctgctccggatagctgcacagcagggcgtcgtcggcggtgatgtagggctcgcactcacaggcgttcaccaggatagtgtccacccgcccctgggcggtgacagccttgatgtcggtggggaaggtggcgccgcccatgccgacgatgcccgcctcccggatgatggagagaatatcgttgggggagagcccctcgtgggtggcgtgaggctccagtgcttgggcgggggtgtcctggtagtcgttgtcgatgaccaccgacagtacggcccggccggaggggtgggggcggggctctacggcggccacggtgcccgacaccgaggcgtggatggtggcgctcaggccttcggcatcgccgatcttctggcccagcttcactggctctcccgccttgaccagaggggtacagggcttgccgatgtgctgaaccattgggatgacgacctggcttggaaggggggcgggggtgggggccgcgccgcgggagagctccttgcggccggcgggatgtacgccgccccagaacagatgtctcatgctttcacctcatttttgaagtcaggtgcggagataggcggaaaaaccggggctgaatacctcgccgccggaggcgtccacccacatggcctcggccccgtagcggtccagaagggcctgcccctccgcctgggggagggtgaacagggcggtggagagggcgtcggccaggccggaatcggcgcacagcacggtgaccgcccgccagtaggcggcggggcggcgggtggcggggtcgatgatgtggtggtagcgcacgccgcccacggtgtagtagcgctggtagtcgccgctggtgaccaccgacacatcgcggacgtagagggtgtggaggaacgctccgctctccccatcgggggcctggatgccaactacccagttctcgcctccaggctttgggccggtggcccggacgttgccccccacgctgagaagcagcccatccggcgcggcgcggcatacctgctccacggcatagcccttggcaatggccccaacgtccagccggagggcggggtcggtgatctgcacggtggaggcggcctcatcaatgatgacagaagagaagtcggtgtggcgagcggccttcgccagagcggcggcgtcggggagggcggcggaggtgggatcgctgatgccagcctcccgggcgtcatgccacagggccagcacgccccccaaggcggcattgacctggccgccggtgccctcgcagaggtcccggcagaagagaagcaggtcgatgattttgcggtccacaaccacgggcgccccgccggcggcgtcgtttaccgccttgaggttgaccacgccgtcatagtcgctgtagatgtcatagagctggtggtactccagcagcgcgtcatggagggactgggcggtggcctgaaagtcctcctcactctccgcatagcccaccacggtggtcacggtgtcaaagagggtgagaaaggtggcctcataccgcttcgcaccctcctcctccggcgcggcaggggatgcgcagccggccagcaggaggacggacagaagcagggggagcaggcgacgcatctcaggcccctgccttttccaccagggttaggaagtcgcccacgccgatggtgacggaggcggcgagatcggcatcgcccgcattgccctcctccgtgacggcgataccagtggcctcggccacggtcttgctggtaacataggaggcgaaggcggcggcttgctcgtcccactccttgccgatggagctgaccttccccatgccgtagtcggcacccagttcattcttggagggctgcgcagcggagaggtcggtggtaatggtcccggcggcgttaaaattcacgttggcctgtaccgcgtcgatgaccatgctggtgatggtgtccccgctcagggtgagggctcccacggtggcgtaggcctgggccaggccatcggcatcgctggtagcgtccgtgctcttggcggcattggtggtggtggtcagcaccagccggtcgcccttggaggcccccaaatgggaggcattggccgcagcctgctcaatcgcgctgatgtatcctccgatggacatggtgacggaggcggtgaggtccgcgccggtgggcttgccctcttcactaatggaaatgcctttcacctcagggatggtcttgccaaccacatagtccgccagggactgggcctgctcgttccactccctgccgatggagctgatcttccccataccatagtcggcgcccagctcgtttttggaggggatcgtgagggtgagatcggagagaagcgcgccagaggtgtcaaaattgagcttggactggatggagtcgataacgcagtcgtaaatgatcccgtcatcgcccaccgtgacggccaccacggtgatgtccgcctgtgccaggccgtcggcgtcggcggtagcgtccttgctgctggacacagaggtgagaagggccaggccggtcttgacggggacaccgccggggacggcggcagggggcgtctccgggctgggggtgggggtttcggcctccggggtgggggcggggacggccaccaccactgtggtgccgcagccggccagcaggcccagggccagcgtcagggtcaggagcagggcaagcattcgtttcatgtcgatacctccgaaacttatttagggggatgggttcctttcatctcaaagtggatcaggaaggagagcagggcccgcagaagaatgacggcgcccagcaccagaagctctttgaggtcccgtaccaagacggtcttgagaatctcggcggccattttgaactccaggctgagggccagaccgttggccagggcgaacttgacgtcgcaaggggtgcgggtgaacaggcttttcaggtaacggccgaaggcgcttaaagccgagaccgccacaatgaagatacccatcagctccagcgccgcaatgatagtgggcaggatacgttcaatcagttgttccagcatgtgcggcctccttgcttcgccggcgcatggttttcagggcgatgaactgactcaacagctccacggtaccggatacccccaggggaccgctgtccaccgtcagatcataccgacccacctcgccccacttggctccggtatgcaggccatagagccgggcccgttcccgatcctggcgcagcgcctcccgggcggcctccgccggggacaggccgcgctctcgcatcagccgctccacccgctgttccatgccgcagtggataaaaatcctgttcagccccggctggccggacagaacatggtcggcgcacaggcccaccaccacgcaggagccgcgtcccgccagtgagcggacggccccttcgtcggcctccgcgtcgccgcaggggatctccagccgggcggccagccgccgaccgatctccaaaccgccgctgccataggtgtgcccaatggtaatcagcatagtataccccctttcccactgtttgttaaaagaataacaaataagccttaacaggacatagatagaaccttaatatttgttaaggtatacacaaaaaatacgcccccgcacggtgcgggggcgtattggagtttaggtatcctcctccggcggcgtgatggtggggaaacggaggagcatggtggtgccccggcctggggcggtgtcgatggtgatggtccccttgtgctcctccattacctgccggacgatggccagtcccaggccggtgcccttgccacgctccttggtggtaaagaagggctcaaagatgtgggggagcacctccggcgaaatgccggagccggtgtcggagacctggaagcagagaaactccccctccggccgggtggccacggtgagggttccgccgccgggctccatggcgtggtaggcattgaggatcaggttgagcagcatctgggagagctggatctcgttgccccggagccacaggtggcggcaggcgagatcggtgcgcacctccacatggggcggccgggcgggggaggctacggcgagcaccttgcgtaccagctcatcgggggatacatactggaaggtgagagaggtgtttttgcgggacaggtcggacagccgggcgatgatctccttggccttgcgggaggagttgtagatctccagcacgttatcatacagctcctcggcatcagagggcagttgctccagcaccagaatggagtagcccatgatgggggtgagcagattattaaactcgtgggcgatactggaggtgagtgtgccgatggtctggagccggtcatggtgggccagctcctgattcttgcggttgagggcctccatggcggcgttcttttcctggagcagggccagctcccgctgggcgcgctcgttgcgccgcccggagcgaaggttgagacccgccagcaaaagcactccggcgatcaccagtccgccgccggtggtgagcagaagggcggagcggcggatgggccgcgatacttggtcgaagtcttcggaaacgcctacggcgaagatgccgttgtttcctgcggcggggatcaccgccatgcgggcggtgtagccctccgcctcatagaagcaggctccctcctggccctccctctggcactggagcagaaagcccaggccaggctccccggcgagaccgtccgccgccagctccacacgtatctcctgaccggtctggcggagcaggacctggccgcccgcgtccagaaggaggatttgatcccggggagaggtggtgaggccgccggccacctgccggtaaaagagagagaggtccaccagcgcggcgtaccacagcccccgctccccctccagttggaaggagagatagacggtgccgttctccgccacgcaggggcggacacggtcccgcccgtccaggctgcccccgacgggaaacgtatagccggtacgtccagaggcggagagcagcacccgcccgtcctggagacagagaaagtcggtgataagggcctcacggataagagggttgttctggagcaattgaaggagctcctccggctgcccggcgaggcaatcggcctccgcatcggtaaagttctccagccggatgaggtagtccagctccccgataaattgctccagggcgcccgaaacgctgcggtccaccgaacgggccagtccgtagagctggctgtccgactgctccagcaggagggtgtcgtagcggccgaagctctgtacggccagggccaggccgccaacggtgaggaaaagaaccaggatcatcagaagaagaacaggaggccggcgctttttttgcccctccataccacacacccccttgtcaaattccggcagattctttatactgaaatcatactggatttcaaaccggctgtaaagggggagaagcacagtggcggatacggtgctgattgtggacgacgatgaagccgtcctcaccatgctctataaggtcatccggagcaacggaatcgaggcggacacggtggcttccggagaggaggccctggagcggacggcgcagcggacgtacgacctgatcctgctggacgtgaatctaatggggatggacggttttcaggtggtacagaccctccggcagcggggcgtccggacccccatcatcatcgtcagcggacgcaaggaggactatgatactctgtatggcctggacatcggggcagacgactatgtgaccaaacccttcaaccccgtcactctgggggcgaaggtaaaggcccttatccgccgtagccgcaacggcctgcctggggcggacagcctcatcaccgccggacccttcacctacaacaccagcaccctgcgcttttataaaaacggggtggaaattccactctccgcaaaggagaacgcgatgatgaagctgtttatcgacaatgtcaaccgcattttctccaaggatatgctctacgatctgctctggggagaggccatcatcgacgagaacgccatcatggtctatgtcaaccgcctgcgggccaagattgaggaggaccccgcccaccccgcctacatccagacggtgcgggggctgggctaccgctttgtggtataaagaactgtctgcggcttgacaaattccggcgaaaacgctagtctataggtacaaatgtatactgttccgagtccgtccgcctacggggtgacctagggctggcggaccgatggccccggctggggccgcagggtgccgcaggaaacggcggtgccttccgtgtttgaaaaggaacgacagtctgcggcggccctctgcacagggaccgccctgcgttgccgtatccttttttaggatgcggcgttttgttttgccccaataaggagatgctgtgtgatgcacatttttttgaccggcccgctccagagcggaaagtccaccgccatcgcccactatctggtggggcggccggaggcccccggcgggttccgtacccgctgggatcgggcgggcggccatctggcgctggagctgctggagacgggggagaccctgagcgttgccacgatggagccccatggcgtgagggccgaccgggccgccttcgacgcggcgggggagcgtctgctgtccgccccggcggggcggcgctccctgctgctgatggacgagcttggctttctggagcggtgttccccggtgttccagcgggcggtctttaccctgctggacggccccgcgccggtgctgggggtgctgcgccgccacgaaaaaagccccttctggggccctgtttcccgccgggcggatgtccggctgctcccgctgacggtggagaaccgggcggagatccctgccgagctggcccatttgctggattgaggtgagagaggaggtgcaggcccttgtccaaaacagaacacaccggcggccgggtgctgctggcattgggcgtactgctggcggcgctgtttgtcctctccttctgcctggggcggtatggggtggacgccggcaccacctgccggattctgctctccccgctcctgccgctggagcccacgtggacggaccatgagtataccgcggtcatgaatatccgcctgccccgcatcgttctggcctgcctggtggggtgctgcctgtccagcgccggggcggcctaccagggggtgtttcagaatcccatggcctccccggatgtgctgggggcctcctccggcgcgtccttcggggcggcgctggccatcctggcgggggtgggcaatcagggcaccaccctgtccgcctttttctggtccctggccacggtggtgctggtctacctggtgggacagcgggcgcccggggaccgggtgctcaacctggtgctggcgggcatggtgatcagctccctgttcaccgccgccacctcctacctcaagctggtggccgaccccaccaaccagctcccggagatcacctactggctcatgggcagcctgtcgggcacccgtctggccgatgtggcccgcatcgcccccgccatggccgccggactgctccccctgtttctcctgcgctggaagctcaacttgctcaccctgggggatgacgaggccagggccatgggggtcaacgccccccggctgcgttttctgacggtggtgtgcgccacgctggtcaccgccgcctccatcgcggtcagcggcatgatcggatgggtggggctggtggtgccccacctgtgccgcaagctggtggggagcaacttcagggtgctgctgccctgctccatgctggcaggggcggccttcctgctgctggtggacaacctctcccgcaacctgctggccaccgagatccccatcggcatcctcaccgccttcacgggcgcgcccttcttcctctatctgatgctgcggaaagggggtgcccggtgatgctggaggtggaacacctgcgcttctcctttggggcgcgggaggtgctgcggggggtggacctgcgggcggagccgggggagctggtctttgtcctgggggccaacggggcgggaaagaccaccctgttccgctgcatcctgggcctgctgcccggctaccaggggtgcgtccgggtggacggctgcgacgtgtcatccctggcgccccgcgccctggccaaaaaaatcgcctatattccccagaccagccatatgatctttccctacacggcgctggagctggtgctcatgggcaccaaccgccggctgggccttttctccgcgccgggccgccgggagcgggccatcgccatggaggccctggaggagctggggatcgcagactacgcccaccggagcttcgcggagctgtccggtggagagcagcagcttgtactggcggcccgggctctggcccagcaggcccggctgctgctgatggatgagcccacctccgccctggacttcggcaaccaggtgcgggtgctggagcgggtgtccgccctgaccctgcgggggtacaccgtcctgctctcctgtcacaacccacagcatgccatgctctatgcccagcgggtggtggccctccacgacggcctggtggccgccgacggcccccctgaccaggccttggacgaggcgctgatgcggaagctctacggtgtgcccgcccgctttgtccgcaccggcgacggggtactcatcgccccggtgcgcaagtccattgtcctgtggacccccgacatggtgcgcttcatggccgacgccatccgggtcaacgggagctgtgcggccatggccgcagccctgtctcaggtgctccccccgggggcgcgggtgtgcgacgcggggtgcgggctcggcgggttgagtctggcgctggccccctactgccgcgcggtggtggcggccgatctgtccgccgaggccatccgccatctggaggcacagcccctgcctcccaacgtggagccccggcggtgcgatgtgctggccgacacaccggacgagccctacgacgctatggtgttctgcttcttcggccgcacggatgagatcctctccgccgcccggcggcagtgtaccggcacggtggcggtgctcaaacgctgcggccgggatcaccgcttttccagggggaaggaccacccccggcagggctttgaggagctgtgccgggagctggaggagaagggcatcccctaccagagccgggttttagagctggatatgggccagcccttccgctccctggaggacgcggcggtctttttccgcacacacagccgggacgatccggcggagctgacccccgaggccctgcaaagccgccttcagcggcgggacgacccggaatttccgtggtatttcccggtaaacgagcccatcggcctgctctggttccaggcctgcgagataccagataaagaaaaggagagatgataccatgaaaaagctgctctgtaccctcctggccctcagtatgctcctggggctggccgcctgcggcggccccgcgcccgcggagggcccctccgcagaccccgcgccggcggtgtccacccccgcccagcccgaggacggctccgcctccttcaccgactccgtgggccgcaccgtggaggtgcccgcggagatcaccagcgtggcggtctccggccccctggcccagatggtgctcttcgccctgtgccccgacaagctggtaggcattgccgacgagtgggacgcgagcgctgagcagtacctggccaccgagtactacaatctgcccctgctgggccagctctacggcggcaagggcgagctgaatctggagaccctcttgggctccggcgcccaggtggtcatcgacgtgggcgagcccaaggacaccatcgtggaggatctggatgccctccaggagcagaccggcatccccttcgtccacgtgtccgccaccattgagaccatgggcgacgcctatcggaagctgggcgagctgctgggcatggaggaggccgagacgctggccacctactgcgacgagacctacgccatggtcaaggacgtggcggagcacgtggagaaggcgaacctgctctacatcaccggcgacgccggcctcaacgtcatcgcccaggggtcttaccacgccgagatcattgacctgctgtccaacaacctggcggtggtggactccccctcctccaagggtaccggaaacgaggtggacatggaacagctcatgctgtggaatcccgacgtaatcctcttcgctcccgacagcgtttatgcctccgtgggggatgatccgctgtggcagagcctcaccgccatccagaacggcagctactatgaggcccccatgggcccctacaactggatgggctttccgccctccgtccagcgttatctgggtatgctgtggatggcaaagctcctctaccccgacgcggcggactacgacctccaggccgaggtgaccgaatacttcgacctcttctaccactgcgcgctcactggagagcagtacgaggccctgatggccaactcgatcgggaagcagtaaactcacacgtcccggcccccaaaaggggccgggacgcttgcatagggcggtggattacgcgtacaatagggaaaaaggaggggagcgcatgaaaattgccattgtgaccggggcctcctccggcctggggatggcctttgtccggcggctggacgcgctgggcgggctggatgagatctggggtgtggcccgccggggggagcggctggaggcgctggcggcggagctgcgcaccccgatgcggccgctggccctggatctgacccgattggagagcgtggagaccctgcgggttctcatgagagaggaggagccggaggtggcggtgctggtcaacgccgccgggttcggcaagttcggcacctgtgccgatctcaccctccaggaaacctgtgacatgatcgacctgaactgccgggccgccgccgcactcactgccgccgtgctcccctacatggggcggggaagccgggtgctggagatctgctcctccgccgcctttcagcccctgcccggcttcaatgtctacgccgccaccaaggcatttctgctccggtacagccgcgccctgcgctgggaggcggcgccgcggggcatccgggtgacggcggtgtgcccagggtggatcaggaccgatttcatggacgtggccagagatacaaaaaacgggcgcaccgtacggagctttcccttcgcccagcggccggagaccgtggcccggcgggccctgcggaacagccgcctgctggccgtcactacctgcggcctgcccgccctggtccagcgtgtggccagcaagttcctgccccactgcttcatcatggcctgctgggagggcctgcgaagggcatgatacaaagcgcccggaaccaaacggctccgggcgctgcgtttatttacgcggcagggagttcaggtagtcgccgacaccccgtgccacgccctccatcagcttctgctgataggtctcgtcgcacaggcgggtgagttcctctacgttggtcataaagccggtctccaccagtacggcggccatgttggtctcccgcaggaccacgaagttggccgaggcgatgccgcggtctaccgcgccgctggccgcgcaggcggcgtcctgcaccgcctgggcaaaggccttgctccggctgctggtggggtagtaataggtatagagcccctggaaggtggggacggtgggggcggagttgcagtgaatgctcacgaacaggtcggcgttgacccggttggccagctcggagcgctcgtacaggtctccggcggtctccccgtcccgggtgagcaccacgttatagccttcattcagaaggatgtcccgcagcttgtagaccatggacagggtgagatccttctcatagatgtccaccccgttggcatccggatataccgcgcccagcgttttcccgtcgtggccggcatccagtacgacggtgtacttgttggggtcaatggggggcagctcgggggagacggagggagtggcggtaatgcgcacgccgctgctgcccgcctccacggtgatgtttttggcgtagctggcaccgcccttgaggtccagcaccacccgcagggtgtggggatagccataccccaagtcgtccccatgctggttgtaacgcaccgaggagaacacatcgctgtccaccggcagggcggcctcgccctccagagcgccggaaaacaccgcgcccaggaggtccaccgctacccggtctcccagatccaccacccggtattccggtatatggtcggtggcgatggtcaccacgtgggaagaggcgtccaccgagatgccggtgacataccccttgtctccggcggcgggcgtgtcgggcgtgggctcgggggtcggcgtcggtatcggcgtgggctccggctccggggtaccgggggaggtgaggatagcggtaaaggtatcgttgtcccagtccacggtggcgcccaactgctccgagacaaagcgcagggggaccatggtgctctcgcggccctcccacttaaccacgccggcgggcacgccaccgggcagctccatggcctgaccattgaccagtgcggtggccgagcccagggtgagtacgatggtgctctcctcccgcaggaggatgacctgacgggtttccggcacccaggttaccgaggcgcccagccgttctgcgatcaggcggacgggtaccagcgtgcggccgttctgtcccaccgggtactgcaccagggcgggtacatcgtccggtgtcagaggcgagccgtccagcgtcaggctgacccggtcggtctgggtcagttcaccataacgctgggcagtctcgtcgtagaagtagacggagagggtccccgcgggaccggccgcccaggcggacagcagccccgccagcagggcgagggtgagcaggaaggaaacggcttttttcatggcagaactcctcggcgatagatgctaatattctaccttattccacaggtgccgtcaagaaaggaccgcaaaaagggttgacataaatttatggcaggcactttgacacgctactgtaaatgtgggcaaatcccttgcgttttgcggcaaaacttgttatgataaacattaaatacaaagcaacggagggaatacccatgctgaagatcacctgtgagggcgtgtactacaagaacgggggctttgtcccggccaaggacggccctgcggccggcttacccgcgccggaaaaggcgagggagggcaccatggcccacgcgattctgaaggcccacaataccggagacaatatggaggagctggccatccgctttgacgccatggcctcccacgacatcacctatgtgggcatcatccagaccgcccgggcctccggcatgcaggcgttccccctgccctacgtgctcaccaactgccacaactccctgtgcgccgtggggggcaccatcaacgaggacgaccatgtgttcggcctgtcggcggccaagaagtacggcggcgagtttgtccccgcccaccagagcgtcattcattcttatatgcgggagcggtacgccgcccccggcaggatgatcctgggctccgactcccacacccgctacggcgcttacggcaccatggccatcggcgagggcggtccggagctggcccggcagcttttatcaaaaacttataacatcccgtacccgaaggtcatcgccatctacctcaccggcacgcccatccccggtgtgggcccccaggacgtggcgctggagctcatccgctccacctttaaagacggagtggtcaagaacgcggtgatggaatttttcggccccggcgtagccaacttgtccatggactaccgctccggcatcgacgtgatgaccaccgagaccacctgcctgtcctccatctggcccgccgatcataccttgaaggcacacctggccgtactgggccggggagaggcgttcaagccccaggcccccgccgacggggcctactatgacggactcattgaggtggagctggacaagatccgccccatgatcgccctgcccttccacccctccaatgcctacaccatcaaagagttcaaggagaacatggatgagctgctccaccaggtggacgaggacacggtgcgccagctcaagctcaagaaccggcccgcctcactgcgggagaagattgtggacggcaaattccgggtggatcagggagtcatcgccggctgctccggcggtacttaccagaatatcgtgcgggcggcccagatcctggacggccgcgccatcggctccggcgagttctggctgtcggtctatcccaccagccagcccgtcaacctggagctgacccggaggggctacattgcctcccttatggccgccggtgcctccatccgctcctgcttctgcggcccctgcttcggcgcgggcgacgtgcccgccaacggggctttctccatccgtcactccacccgtaacttccccaaccgggaggggagcaagccctccgacgggcaggtgtcctacgtggccctcatggacgcccggagcattgccgccaccgccctcaacggcggcgtgctcaccggggccgacgagctgcccgcacccccggccgatcctgccgaggagcccttcgcctacgacgacaccccctacaaggcccgggtctacttcggcgtggggcggcccgaccccggccaggagctggtgttcggccccaatatcgccgactggccggagcaggtggccctgccggagaacctgctgcttacggtgtgctcggccatctatgaccccgtcaccaccaccgacgagctcattccctccggcgaaacctcctcctaccgctccaaccccgtcaagctctccgagttcgccctcagccgcaaggatccccagtacgtgccccgggccaaggaggtgctggcggtggaacggctccgccgcaccaatcccggcgatccccgggtgggggaggccctgctgggccatgatccggcggacaccggcctgggctccctggtgatggccctcaagcccggcgacggctccgcccgggagcaggccgcctcctgccagcgggtgctgggcggcgcggccaacctggccgcggagtatgccaccaagcgctaccgctccaacgtggtcaactggggcatgctgccctttatcgccgaagacgtgaaggactggaacctccagccaggcgaccggatctacctgcccggcatccgcgccgccgtggacggcggggcggaggaggtatcggccgtcctcctccagaacggcactgagcggcccgtcaccctcaggcttcccggcatgacccgcgaggagcgggacatcgtgctggcgggctgcctgatcaactactacgccaagtaggggcggcctgtggccgcccgcccctgaaaaagcggggaagcgtaggggccgatgccctcatcggcccgccgttttccggagccctttacatgtggccgtatggttgggaaggagggaggacttgtatgagacggaatctccttgcattgcttgtgtgtgttctgctctgcctgatggtgctcccaagcaccgcctccgccgacagcgggcccaagcccgccgtcaccatcacggtggtcaacgccctggcgggggagtactacctggatctgctcgtcaccgaccccggcgaccatgcaaacatcgatccggcagactacgaccccaatcttctccaagggctgcgggactgggaggtagacggctggtaccccgccctggcgggaggcaccagcgttcctctgttcggagatctgcggccgggggaggacggtacccatcgttttacctactacggcctgccccgcgcctttcgtatcgccgtctccggcccagacggggcccaggccacggacgagccctttacccgcacggtgttctacacccatctgacgtacgactgggagaccaactccattacaagggccacctccccggcggggttctacggcgtccagtttttatccaccctggtgcccaccctgctggtggagggtgggctgctgtggctgttcggcttccgggcacgccgggactggctggtgttcctcgccgtcaacctagtcacccaggcggggctccacctgtggattgcggcagatctgatttccgttggcgattctgcccttcagtatctggtgctcctcgtggcggaggtgcctattttgctggtggagctgattgcctatgtgttcctgctgaaggagtacagcgggctccgccgggcggcctacgccgcctgcgccaatatcgccagctatgccgtgggttatcttcctctccactgggcggtggaatttctggcccggtgagaagatttgttttacatgggcggcaaaatacggtataatacgatatgccgggtaggaattacccggcgtatcgcctgttttattgagataaggggaagtatatgaaaaaaatccttgcgggagcgtgtctgtgtggccttctgctctctgcctgtactcctgccgccgaaccgggggacgacggcacgcttcacatcctggccaccacctacccggtctacctgttcaccacagcggtgaccgagggggcggaggatgtggaggtaagcctgctggtcaaccagcccacctcctgcctccacgactacacgctcaccgtcagtgacatgagggccatcgagaaggccgatgtgcttgtgatgaacggtgcggggctggaggactttatgggcgacgccctggcggcctctgacgcggcggtgatcgactgctcggagggcattgagctcctgcccgccctgggccacgagggccacgaccatgacaccgagtacgacccccacatctggatgtgtgaagagtcagcactggttatgatgaataatattcttcatggcttaggggcgttggacgagaaaaatctggattgctaccgtgaaaatgccgctgcggctgcggccttggtgccagaagatgacgcacgaatggagaacctagcctgtccttatctgatcacgttccacgacgggtttcagtattttgctctggacaacggcctgaacctactgaagtccatcgaggaggaggagggggcggaggcctccgcagctgagatccaggaggttgtggatctggtgagggaatatgaaattccagctatctttaccgagcgcaatggctctgaagctaccgcccgggccatttcccgggagaccggctgtgcggtgtaccaactggacatgatcatgagcggcgacggcacgggcatccagccctacctcgacgctatgcagaaaaatatcgacaccatcgcggaggcattgggatgagcgtacacaagcacggaaccacagggcccggctgtgccggtacctgctgtctgaaagccaccgaccttggggtgagtttcggcggggaggaagtattgagagatgtttccttccacctgcactgcggggagatcgtggcccttatcggccccaacggggcgggaaagagctctcttttccgtaccatcctgggacaggtgcctcacaccggaaccattgagttccaacgggcagggggcgacaagacccggccgctgatcggctacgtgcctcagtctcccagctttgaccggggagacccggtcagcgtgttcgacttcttctccgccgctatctcccgctatccggtgttcctgccctccccccggagcctgcgggccagagtgggtgcatgtctggcccgggtgcatggggagagcctgctggaccggcggattggggccctctccggcggcgagctccagcgtgtgctgctggccctggcgctggagccgctgccccacattctggtgctggacgagcccctctcaggcgtggacattgacggggagaagcagcttctggacatgttggacgagatccgtacccgctatgacctgtccatcctcctgtccacccacgacttcgccaccctgggccagtttgccgacaaggtgattctcctcaagggcacggtgctgcgggtggggccgccggatgaggtgctggcctcgccggagttccaggaggtctttcacctgaacctggggaaagggaacctggggaaaggagggaggggctgatggatttcctggccgggctcttggagccctttcactggcagttcatgcgcaacgccctgctggcggtgctggtaatctcgccgctgttcggcctgctctccaccatggtggtcacaagccgtatgtcgttcttctccgacgcgctgggccactccgcctttaccggcattgccatcggcaccctgtgcggcctggccgatcccctgtggatggcggtgctgttggcggcggtgtttgccctgctgttcacctatgtgcgccgaaagtccaatatggccagcgacacggttatcggcgtcttttcctctaccgccgtggccctgggtatctttattgccaccttcggcggcggcagcttcacccagtacaacagcctgctcatcggtgacattctcagcgtggagcccgccaagatcgccctgctggcggtgatccttttggttgtggtactgctgtggctgtgctccttcaatcagctcatgctgtcctccatccaccctgccctggcggacagccggggggtgggggtgttctggcaggaggcggtgttctccgccgccatcgccgtggtggtcacggtatccatgacctgggtgggtctgctggtcattaactccctgctggtgctcccggcggcagccgcccggaatgtggcccggaacatgcggcagtatcacctgttctccttgcttggggcggtgatctccggcctggcggggctgatgacctcctattatatcggctcttccgccggggcgtccatcaccctctatctggcggtttggtttgccgtcacctttctcctgcgaaaaaagtgtatataagcaagagcactgcggaagcttggcttccgcggtgctcttgcttgctttttatgcctgaatcgaatccaccaaggcgtcggccagggcatccagctccacggccttgtcgtcggagagagaggaggccatactcaaccgctcgttgaggacggtcatgtttttcatctcctcatcgatgaacttctgcatgagatctccggacttgcaggcccaggagccgttctcaataagggcgaaggtgcggttctggaggttgagggctttcatgtcctccaggaagctcttcatcaccgggtagatgcccaggttataggtgacggaggccagtacgatatggctgtacttgaaggcttcggagatcaggtaggacacgtgggtgttggacacgtcgtacaccgacacattggtgatgcccttctcacacagcctggcggccagggcctgggcggcggcctcggtgttgccgtacatggaggcgtaggcgatcatgacgcccttttcctccggctcatagcggctccacttgtcgtacttgtcgatgaagtagcccagatccttgcgccacacgggcccgtggagggggcagatgaacttgatctggtccagaatgccggcggccttgcccagcagcagttggatgtgggggccgtacttgcccacgatgttggtgaggtagcggcgggcctcgtcaatccagtcccggtcgaagttgacctcgtcggcgaagagcttgccgtccagggcgatgaaggagccaaaggcgtcggcggagaagagcgcgccgttggtggtgtcaaaggtgaccatggcctcgggccagtggaccatgggggcacccacgaaggtgacggtatgcttgccgaagcagtgggtgtccccctccttcacctcgacacactcgtgctcgtcggggtggaagccgaactgccgcatgagcatgaaggacttctcagtggagatcaccttcaccttggggtagcggcggaggatctgctccacgctggctccgtggtcgggctccatgtggttgaccaccagccagtccaggggcttgtcgcccagcaggtggtccaggttgtcctggagctggcggtaggcggaccagtctaccgtgtcgaagaggacggactgctcgtccaacagcagataggcgttgtaggaaacccccctggggatggggtggatgttttcaaacaggtggagccggtggtcgttggcccccacccaatacagatcgtccgttaccttgcgcacgcaatacattgcgattcctccttctgttcgttaggcctcaatgaactgatccttgccctcggcgcactcggggcagacccagtcctcgggcaggttctcaaacagggtgccgggggcgatctcggcgtcctcgtcgcccagctcagggatgtactcatagccgcagccgccgcagacatagcgcttgccgatgggctcgggcttgggggcgggaggccgcttcatcttcaccatggggggcgccggctgcttctcaccagtgtccagggcggcggccagcaggggcaggatctcgttgacatcgcccacgatgccgtagtcgcagttcttgaagataggggcgttgccattcttattgatggccacgatggtggaggcgtccttgatgcccttcagatgctgggtggcgcccgagataccgcaggcgatgtataggttgccggtaaacttctggccggacatgcctacatagcggctcagaggaacatatttgagcgtctcggccaccgggcgggaggaacccaccgcggcaccggcagctttcgccaggttctcaatgagcttcatgttcttcttgtcgccgatacccttaccggcggaaaccacccgctcggcctggttgatgggggtgtccatggggatgcccacggtaaagtcgtgtccgtccttcttcagtgcctccaccagggcggccaccttgtcctcggacgctccgtcccggaaaagctggcgcttgcgcacgccggtgatgggggcgggctttttggctacagagcggctgccgccgccgctgcccttggagattttgccgatgagatgggaggcaataaccacccgctgaatctcattggtgccctcgtagatggtggtgatcttggcgtcgcggtacatccgctccacgtccatacctttgaggaaaccagtgccgccgaagatctgcaccgcgtcgttggtgacctccagggcaatgtccgaggcgtacatcttggccatggcggactccatgccgtagggctcgtggtgctccttcagctcggcggcggagtagatgaggaaccgggcgcagcgcagcttggtggccatgtccgccagcttgaaggccagggactgctgggcggcgatgggcttgccgaactgaacccgctccttggagtactccagggcggactcataggccccctgggcgatgcccagggcctgggctgcgatgccgatacggccgccgtcgagggtggccatggcgattttgaagccgtcaccctccttgcccagtaggttttccttgggtaccttcacatcattaaagatcaactcagcggtagaggaggagcggatacccatcttgtcatagtggtcgccgaactcgaaccccttccagcccttctccacaatgaaggcggagatgccccgggtgccgatgtccggggtggtgacggcaaagaccacataggtgtccgccttgggggcgttggtgatgaagattttgccgccgttgagcagccagtggtcgcccttgtccacggcggtggtctcggtgccgccggcatcggagccggcgttgggctcggtgaggccgaaggcgccaattttttcacctctggccaggggcaccagatatttcttcttctgctcctcggtgccgaaggcgaagatcggccaggagccaagggacacgtgggcggatagaatcacgcccgtgccgccgtctacccgggacagctcctccacggcgatggcgtagctaatggcatccagccccgcgccgccgtactccttggggtaggggatacccatcaggcccagctcccccagtttttttacggcttcggccggaaactcattggcctgatccagggagaaggcgatgggcttgacctcctcttcggcgaaggcgcggatcttggcgcgcaactgttcatgcgcttgggtcgtctggaacaacatgttgcttcctccttacacataattaaaagtggataaaattagtccaatttgtaggcgaaaaaatcagtctgccggacccagaatgtcctccaaagtgtgggccttcagttccgcattcagcttttcctgaatgcctgtcagatggcagtgaaccgtacagccgccatggctggcccgccagggacaggaataggtgggatccatacaactgcttaggcgggaatcctctcccatagcggtcatcaggtcgtagagagtgacccggttgagctctgccgacaggcgacagccaccttcggcgccgcgggctacctccacaaatccggccctggcaagctttttgagaatcttgtgtgcaaaggactgggggaccagctcccgctccgccgcctccgccgctgtacggcgctccccatcccgcagggtgcgcagcaggcgcagggcataatcggtttcgcgggtaatcacagccgctccactcctttctgattggtctggctacaacatatcattttggataaagtttgtcaagtataattttccaaaatcgtcacaatgtaaaaaaacgcgcggcatgttttggcatgccgcgcgctgaggtcaggattttcagcccagcagatggatgctggtgatcaggccggagaacacaatggaaacggtggagcacagcttgatcaggatgttgagggagggaccggaggtatccttgaaagggtcgcccacagtgtcgccgatgacggcggccttgtggcagtcggagcccttgccaccatgggtgccgctctcgatgtacttcttggcgttgtcccaggcgccgccggcgttggacatgaacacggccaccacgaagccggtgacggtgacgccgcccagcaggcccaccacggcctctgcgcccagaatcaggccggtgaccacgggcactacaatggccagcagggaggggaccaccatctcatgcagagcgcccttggtgcagagatccacacaggaggcgtagtcggggtcggccttgccctccatgatgccggcgatctccttaaactggcggcgcacctccaccacgatggactgggcggcccgctgcacgccgctcatggtcagggcggcgaagaggaaggtgagcatggcgcccacgaacaggcccaccagaacggcggggttagtgatggagagatccagcgtgtccaccttgaccttcaccacgtccacatagctgaccagcagggccagggcggtgagggcggcggagccgatggcaaagcccttgccggtggcggcggtggtgttgcccagggagtccagggcgtcggtgcggttgcgcacctcctcgcccaggccgctcatctcggcgatgccgccggcgttgtcggccacggggccgtaggcgtcggtggccagggtgatgcccagggtagacagcatgcccaccgcggcgatgccgatgccatacaggcccttggagaaaagctcgccatagttggccgcattggtggtcagggaaccgccggcggccaggaaggagacgatgatggccacgccgatgatgacgatgggggcggcggtggacttcatgcccagggagatgccgccgatgatggtggtggcggcgccggtctcggtggagtcggccaggccctgggtgggcttataggtgtcggaggtgtagtactcggtaaaatagccgatggcgcagccggccaccagacccgccagaatggcgatgtaagggccccaggagcccatgatgtaataggtgacgggggcggcgatgacggcggccagcacggcggcggtgtaggtgcctttgcgcagagtagccagcagggacttctgggtggcgttctccttggtgcggatcaggaaggtgccgatgacggagcacaccacgcccaccacggcgatgatgaggggcagaagcatggcgttccaggtcaggccatcggcggcgtaggcggaggcgcccaaggcgaaggtagccagaatggagcccacgtaggactcatacaggtcagcgcccatgccggccacgtcgcccacgttgtcgcccacgttgtcggcgatggtggcggggttacgggggtcgtcctcggggatgccggcctccaccttgcccaccagatcggcgcccacgtcggcggccttggtgaagatgccgccgcccacgcggccgaacagggccatgaaggaggcgcccatgccgaacatgaccatggtctgggcgatctgggcggcctcaaaccctgcgatgtacttgagaatgtggaaccagatggacacgtccagcagacccaggcccaccacggtgaagcccatgaccgcgccggaggagaaagccacgttcaggccccggttgaggctctcatgggcggcgttggcagtgcgggcgttggcggaggtggcaatcttcatgcccacaaagcccgccaggccggaccagatgccgccggtcaggaaggcgaaggggataaaccagttgtccagcatcccgactcctgccaaaattaacaaaatgacgaagacaatgataaagatctttgcaacggtagtatactggcgcttaaggtaggcatttgcgcccttacggatggatgcggccagcttttgcatcagttcggtgccctctgagaacttgagcaccttcttggcttgggttaaggcgaagattaatgcaattaatgcacctactaagccgacccaaaacaggttttccaacaactttccccactcctttttttctttggaagccttgtaacacaaggcttccagcgttaagagacaatataatattaacgcaaaaaggggtgatttggcaagtatatcttaagataagaaagcgtcaaatcctaggatttgacgctttcgacaaaaacgaatgattggtttaagaacgcttccatgcatttctgctaaagagaacgagaacaggcagaacctccaggcgcccgatcagcatacacagggagagcaccagcttggagaagccggaaaaggcggagtagttgcccatggggcccaccagctccagtccggggcccacattgccgatgcaggagactacggcggtgaaggtggtgccaaaggagaagttgtccaccgacaccagcagcgtggcccccagggcgatgaaaagataggctgcaaaaaagagctggacggagcgcaggctgtcctcatctaccacccggccgtccagcttgaccacgttgacggagcgggggtgcaccacctgccggatctcccggcggatgcacttgagcaggagcagaacgcgggagcacttgatggcgccgccggtggagccggcgcaggcgccgatgaacatgagcagcaccagcagaatccgcgaaaactccggccacaggttgaagtcagtgctggcgaagccggtggtggagataatcgagcccacctgaaatgcggcgtggcgcacggcggagccgtccgccggatacatgggccagatgttgatggagatcaggagggtgctgaaagccaccacggccagaaagaagcgcagctcgtcgctgcggagcgcctggcggaccttgccgcagagcagcaggaagtagagggcaaagttgatggagaagaccagcatgaagagcgtgatgatgacctcaatggcagggctttcataggccgcaatagacaggtttctggtggagaagccaccggtgcccgcggtggcgaaggagtgaaccaggctgtcataccacggcatgccggcgattcgcaggcagaagacctccagcagagtgagggcgcagtagatgccgtagaggattttggaggactggctggtcttgggtaccagcttgctcacaatgggcccggggctctcggcgcgcatcacatgcagggtccgtccgcccaggctgggcagcagggcgatggtgaggatcagcacccccatgccgcccatccagtgcatgaaggagcgccagaaaaggattcctctgggcaggggctccactgcggtcaggacggaggcgccggtagtggtgaagccggagaccgactcgaagaagcagtccacataggaggggaaaaagccgctgaaaaagaaggggagggcgccgaaggcgctcatcagcagccagatgagggccacggcgaaaaagccctcccgggggaaaaagtggtcgttgctgcgtatgagggaaagggcgagccccactgctcccgtcatggcaatggacaggaggaagggaaggggattttcgcggtagaacaggcagaccagcagggggaggagcagcgcgcctgcctctaccagcagggtcttgcccgtcaacttgaagaccaggcggaagttcatgcgtcgcctcccagctccagaagggagtcctcaaagatgtcgttgagatccagaatcccgtggttgcgggatatgacgatcacggtgtcaccagcggcgatggaagaggagccgtcagggattacgatacggccctggtgcaccaggacggcgaccaggatgccaggcttcaggcgcagctctcgcaggggggtgtcccggtttcgggtggttgcattggccacaaattccatagcctcggcgtggccgtcggcgatcttgtagagggcgttcatgacgctgcccttggagttctgcataccgcgtaccacctgaagaatctgcccggcggtcagcagcttgggggagatcacgctgtccagcccagcggcgtgggcgatgccggcataattctggcggttggacttggccaccaccttgggtatgccctgctgcatggcgtagagggagataatgaggttgtcttcatcccggtcggtgagggctacgaaggcgtcggaggcggtcacatcctcctcctccagaagttcctggtcggtgccgtcgccgcagatgaccgtggccttgggcagtacctcgctgagatggcggcagcggtccagactgcgctcaatgatctttacgtgtatgccaagccgctccagaatggcggtgaggtagtgtgcgattcgtccgccgcccaccagaaatacgttgcggcacctgggattgtgccgccccagcaggcgaaagaaggcggtcaggccggtaggctggccgatcagatagagccggtcccccacctggggcacaaaggaaccgtcggggatgaccacatctccctccgcccgctcggcggcacagaacagcatagggagggactggagctggccgctctgggcggacaggggatgtcccaccagaaagtcctcctcccgcacccggaagccaatcagctccacccgaccccggcaaaaggtctccagattggcggcagggggaaagcgaagcagacgggcgatctccgccgccgcggcgttttccgggttgatgaccaggtcgatgcccagggcctccttcagcagggagagctccatagcatattctacattgcgtacccgggcgatcgtatacttggcgcccagccgcttggcggtcaggcagcagaccatgttgacctcatccatactggtggcggcgatcagcacatccgcagcatccacacccgactctctcagggcggaaatggacgcgccgttgcctttgacacacatgacatccagggcctcagaggcgtggcggagagcggcgtcgttggtgtcaattacggtgatatcgtgctcctcctgagagaggtgctcggcgagggtaaagcccaccttgccgtcgcccacgatgatgattttcaaactccatacatcctttcagagcgcccggaggtgccccacaacacattgcatgctaatcttaacgcaatcttaacacgcatgcaaggacattatgcgtaatttgccgaaaaagagcccctctccacagggagaggggctctttttcggcttttataccgtccattcactgtgcaccaggccgaccagataccagtcaccctgatagcattcaaacaccagtttgagagaacaccagtcgtatccggccatctgttcgtccagaccgggaaagtgatactccacaaaacgtccctccggataggcggaggccacattttccagcgcgtttccctgcatcagaacggtgtctaccgccgtctcaggggcggcagtatagtcggcattgaagacgtagcgctcaaaatactcccgtccggtcagttcaatgggggcgccggtgccgtcctcaataccccacacataagggatgtcgtcctcgggcaagaggacgagctgggcggggaggagattgcggtcacaactgggctccaccgtggagtaaggcgtcagggtaacccctttctccgggtgcaccagcgcggccagggcctcataatcgctctccttcagcgcggcgagaacctgtccggcacggtcggacaggcaggaggtgccggcgtcggccggcgcggcctggtagagggtagatctaccctctacctcaatagcgtccagcgcggaaactgcgggatactccgctgcggtggcacggaccgagttcaggctggcagaggagatcccgctgccgaacagggtgcccagtgcaagcccgcccaaaagggcgatcagggcaaatagcacggccttcttcatccggtacacacctttcctgtcaggggaaattcacaattctttattttaaaagcagcacacaaaaaaagcaacaacaaaaggttacaaaagctaggatgcttttgtatatcttgcaatgatggaaaaaaggaggtataataaaaaatagttttttgtcagaacaaggaggattatcatgcacgaacacgagctgcaatttcatatcaaatgtaaggccggcgacgtgggccgctactgtttcctgcccggtgatcccggccgctgcgagaagatcgcagcctactttgataacccggtgaaggtacagagcaaccgggagtacaccacctataccggaacccttctgggggagaaggtgagcgtctgctccaccggcatcggcggcccctctgcggtgatcgccatggaggagctgcacaacatcggcgcggacaccttcatccgggtgggcacctgcggcggcatcgccctgcccgttaagagcgacgatgtggtgatcgccaccggcgcggtccgccacgagggggccagccgggagtacgcccccatcgagttccccgccgtgtccgactatgaggtgcagagtgccctggtgcaggctgccaaaaacctgggcaagccctggcacgccggcgtggtgcagtgcaaggattccttctatggacagcacgaccccaagcggatgccagtgagccaggagctgctctacaagtgggaggcgtggaagcgcctgggtgtcctggcctccgagatggagtccgccgccctgttctgctgtgccgccgccctgggggtgcgctgcggctcctgcttccacgtcatctggaaccaggagcgggaggctgccgggctggatcaggaggagagccacgatctgtccgccgccctggaggtaggcatcgaggccgtcaggctgctgatcgaagccgaccgggccgcgaaggggtgagccgcagaaccgctccgccctgcctttgcatagtgaaaaatgcctggaaccatgtggttccaggcatttcttattgcttattttaccgttttcagcgcccgcatggcgttgagaatggcgatgacggacacgcccacatcggcgaacaccgcctcccacatattggcaacaccggcggcgctgagcgccagcaccaggaacttgacggccagggcgaagacgatgttctgacggacgatggccagggtgcgccgggcgattcgaatggcgtcggcaagcttggagggcttgtcatccatcagcacgatgtcggcggcctcgatggcggcatcggagcccaggccgcccatggcgatgccgatgtcggcccgggagagcaccggggcgtcgttgatgccgtcgcccacgaaggccagggcccccttgggggagacctcacccagcagagcctccacacgggtcaccttgtcggcggggaggagctgggtgtgtacctcgtccaggcccagctcctgtgccactgactcacccacggctttggcgtcgccggtgagcatgacggttctgcgcacaccacaggccttcagcgcggtgatggcctccttcgcgtcgggcttcacctcgtcggagatgacgatgtggcccaggtagaccccatcggaggccacgtggacggtggtgcctacccggtgacaggggtgccagctcacgccgatgtcctccatcagcttgtcgttgccggcgcagatctggcggccgtccactgtggcccgcacgccccggccggacagctcctccacattggatacccgggaggcatccaattccttgccgtaggcctccttgagagagcgggagatggggtggtcggagtagctctccgccagggcggccagctccagaagctgcgcctcgccgcagtggtcgggatggatggcggtgacgttaaacacgccgcgggtcagagtgccggtcttgtcaaagaccacgagttccgttttggccagtacctccagatagttgccgccctttaccagaataccgtttttagaggccccgccgatgccgccgaagaaggacaaggggacggagatgaccagggcgcaggggcaggagaccaccaggaagttcaaagcccgctggatggagtccacccattggatggaggtaaacagggggggcaggagggccagagccactgcggccagcaccacggcgggggtgtagtaccgggcgaacttggtgatgaagttttctgccttggccttcttgctggaggagttctccaccagatccagaattttagccacagtggactcctcaaaggccttggtgacccgaacccgcagcaggccggacaggttgacacagccggagatcacatcgtcgccgggctgggcctcccgggggagggactcgccggtgagggccgcagtgtccacattagaggtgccctccagcaccacgccgtccagggggatgcgctcgccggccttgatgacgatggtgtcacccaccgccacatcctcggggtctacctgccggagctgaccgtccacctcaatgttggcgtagtcgggccggatatccatcagggaggtgatggacttgcgggactggtctacggcatagctctggaagagctcgcccacctggtagaacagcatgacgaatacggcctcggggtattcgccggtggccagggcgcccacagtggccaaggacatcagaaagttttcatcaaagacctggccgtgggcgatgttgcgcacggcccgccacaggacatcccaggcaatgacggcataggggatcagaaaggtgaacagccgcagccatccctccgtgggcaggagaagtgcgaccgcaaagagcactgcgctggcgaggacgcggaagagcattcgcttctgcttcttggacataggacatcgctcctttgaaaaaatccgggacggccgccgtaggccgtccctggtgtggtcagcggacgatggtacagtctggctccacctttttgcacaccttgacgacctcgttcagaatttcatcgaaccgggtgtcgtcggcgtccagagtcagcttctgggtcatgaagctgacggtggcgtcgtggacgccgtccagcttcttgatagcggcctccatcttggcggcgcagttggcacagtccagatcaatgagcttaaagtgctttttcatggtaaagtctccatttctttatagaatatgcagaggcagcagctccgccacgtgctccatcccctggtccaatatggtgcgcacgtgcccgtcggccagagaatagaatacggtcttgccctccctgcgggccttgaccagcctgctctgcttgagagagcggagctggtgggagatggcggactgggtcatgcccaggagctgggcgatgtcgcagacgcacatctctgattcaaagaggacgtacaggattttaatgcgggtggagtcgccgaagattttgaacagctccgccaggtcgtagagaacctcctcatccggcatgttctggttgacctggttcacgatggcctcatgcacatgcatgtactcgcagcgttccacatccttgggttccggcatccgatcacatcctttctaaaacatatgagctattgttcatgtgttattatatgcttagttgttcaaatgtcaataggttttgcaaaaatatttttattgcccaccaggtgatctggcggtatgattagaaaaaaggagggaaacacgatgaagcgagacgcaaatccggagaaggggctggaggctctggatcagtgtgaatacatggttctggccatgactgatggagagggaaagccctactgcatccccctcaacggggtacgggcgggggagaagatctatttccactgcgcaaaggcaggggagaaggtggactgtctgcggacccatccgcaggtctgcctgaccgcggtgggacaccagcgggtgatccaggccatctatgagacggagtaccagtgcgcagtggtacgcggcaccgccggagaggtcacagacgagacggagatgcgggaggccctctgggctctctgccgcaagtacagcccggactgcctggagcgggtggaacaggtgattgacgacagctttgcccgggtggccatctggaaaatctgtattgagtccgtcagcggccgctggagggactacagcggccagggctgaccagaggcgcgtatgtggattctatatgcctttgcctccgcgttctttgcgggagtgaccgccgtcttggccaagctgggcatggagggggtcaattcccatctggccacggccctgcgcaccattgtggtggcgctcttcggctgggcaatggtttgggtggcgggctccagcggcgcagtcggggcacttgaaccgcggagctggctgtttctcatcctgtccggtctggccaccggagggagctggctgtgctattttcgggcgctccagcttggagaggtcaaccaggtggcccccgtggataaatccagcactgtgctgaccatgctgctctccatcctgttactgggagaggcggcccactggaatacgttattggggatggggctgatcctggccggcaccctggggatgctccagcggaagccccgggaacgggcctcctccggctgggggtggctgccctgggcggtgctctccgccgtgtgcgccagcctgacttccatcctgggcaaggtcggcatgaccggcgtggactcctatgtcggcaccgccatccgcaacatggtggtgctggcaatggcctgggctctggtgctcgggctggggctccagcgggagattccgacgctgagccggaaaaactgggggtttctggctgtgtccggcgtgtctaccgggctgtcctggatgttttactaccgggcgctccaggaggggccggccagcgttgtggcccccatcgacaagctgagcattctagtgacagttggcttttcctgcctggtgctccgtgagcggctgagccgccgggctgccgccgggctgctcgtgctcacctgcggcacccttcttttgctgctgtagcatgaaacagcgccccatggcttttgccacggggcgctgttttggcctaaacagaggcagccgcgtttgtttttttccgtctgcggcggaggaacagcagggcgagaagtaccgccgcagccgcggcggccagtacccaggggagaagggttccgcttccggaggcgctgagcagcagagtaccggcggtgggggcggtgagcaccagatagctgccatcccgctccgcctcgatagggacggcggagccgtcctgaagcagggcagcgcgcacagatcccctaagaccgtcggcgcatacccgcagcgtcacggtgtcagggagctccgccccgtccgtgatctggtagtcataggcggcagcgccgtctaccggctccggccgctgtgccagctccagccgtgcgtcgggagagaatgctccctcggcgagaagcagggggcgttctccgccggaggagatagtggtcacccagtcctcgtagactgcctccaccgtcaggctccgggtgatgtggttgtggtcaaagggagcccaggcgccatagcgcccgccgtcgctgggtacttccgggaaggcggcggggtccaggctgccgccgtagggcacctccactgtgtccaccacccgctccccggcctggaaggtgacgcggaaggtgagaaagtccgccggaatgccctccagggcggagaaggcgccaaaggagaggggggcggtctgtccggcgtagtcgatgccgtcaattccgactgccttctcctgaaggtaatagttgccggaaactgtgccgtcagcccagccggccaccgcgcccagacgttcgccgctgccgtcgatgcgggtcatggcgatgcagtccgcgatatccctgccctcgccggcaatgccgcccaggctgctgtccccggttacgtcggcctgggcggcacaggagcggagcactccccgggagagccccgcgataccgcccgcaaaggagccgtcgtcggcccccacgggtcccatactggtgcaggagagggcagcgcccacctcgccccggcccaggacaccgccggcgcactcgttcttggcggtgacggggccacggttgtcacactggtagaggatcgctttgagcagagcggtggtatccaccagcagattttcaccgtccagctccagattctcctcggggtccagggagagctcaggggagaccgctcccgcaatgccgcccacgttggtgtcggcctggatgccgccctcattccggcagcctaccacccggcccgggccgctctgggccccctcggccgaagtgttctccttcaccgtcttttccggaacctcggtcagttccacaatggctttccgggcctcgtcaagctgtccgatgatagcagtggtggtggcatgcagctcctggttggtctggccggccccctgggtcatctgatccacccgttggctgatgtcatccaagtgcccgtccagctcgtccaggcgctcctgtcccttgtcgcccaaggtgtccagatagccgttcaggacatcctcgatgatatcggcctggctgttaaccacccggagctgctccacgctgccctggctgaaatccttgacatggccgttcagggcatcgagggccttttccagcgcccgggcggcccggtccatgtcacggcgggcgtcgcccatctcatctccggcctcttgccacagcgctgtcagacggtccgccaagtggaacgtgtcggaacccatggcctccagatggccgctgatgcggctgaggtgcccgttgaaatcgatggaacccacatcccagcgcttataggcatccaggatgccagccagatccaggcgggccgcagcctggagggcgtccttgacaaaggactccagccggtcggtctcgtccgcgatctgacgcagctccgacacaagaccgctgtgttcccgctccagtgcgtccagcgtggaggagagactgtctccggtgtcggacaggctgtcctccagagtgccggtcagatttttcagccccttgcgtagggcggtgagctggttgcccacctcgtccagatcggcgctggcccgccgggtgaggcggtccacctcgtccagcaggccgctcatggccccgttgatggtctggaccgcgtcgtagacctggtcggcggcggctgaggtgtctgtgttgaaatcgctgcccgttccgtggattacgtcctggatggcggagagggagccatggatagcggagatatcgtccactgcatctccggctgaggaatggatttggccggagagctgagtcatgagggtggaaagggaggccagggcgccgtccagccgctccatggggtcctctccgtaggtgagggtcacgtagggttcaaactggcccacgatgccccctacgtccttacgccccaggatctcaccatcgttgaagcagcgaagcagagcgccgttctgaatcccggcgatgccgccggtgttgtatccggtgtgggcgtagcccacagcggcgtgattggtgcagtcggccacggtgccggtattgcgcccggcgatgcctccgctgttggtggcggcatcgtttccaccagtgttgacttcccccaggttagtgcagctctggatcatgccctcattgcgcccggcaatgccgccgctgttggtgtttccggtgacagaggcccggttggtgcagctccgcaccacgccggagctcccgttgacgcctaccagtgcgcccacgtcctcatctcccgtcacatcgccagtgacggtgacttgttccactgtgccgtggttctcaccggccaggatgcccacctgcgactgggagccgccaggggccactaccccgtccagaatcagattttttacgacagccccctcgcccagcgtgcggaacaggcctaccttggaacccttgtccagccaggcgaagccggaaatggtgtgtccggccccgtcaaaggtgccgcggaacacgggaatggtggaaaagccggtaccagccagggaaatgtcggcggccagcaccacggttaccccttgagaccaggtatccgaggtgcagctttgggccagcttgagcagcccgctggcatcatgaatggtgatggtatccccctccgcgccggcggggggcagcagtcccaggcagaataccagggccagcagcagggcggcgccccgttttgcatagttcatcatggcgttattcctccgtttcatccagttcctgccgcttgctctcaatgagggcatccacgctgccgtggagcacgcccttgaactcgccgtcaatgaaaccggacacgtggccccggacgtgtccgtccaaacgcatggtgccgttctggaagcgctgtttccggtcccggttgagggtaatggcggtgcgctcgataagggcgtcgcccagcaccaggagctggggcagcacagtcatgaccaggacgatggaggtcagggtgccacggcccagggtatcgccgatggaggagataatggtgtcggtggacagcttgccgatgagaaagccggccacagtcatgatggagccggaagtaagcacggtggggaagctctggttgagcgcctccacggcggcggcccgacggtcaagcacggtcttgagctgtaagtagcggttggtgatgacgatggcgtagtcaatggtagcgcccatctgtatggcgctgacaatcaggtagctcataaaaaacaggttggtgcccgtcaggaaggggaaggagaagttgatccaaatggagccctggatggtgagcaccagcaggatgggcagcccagcggacttgaaggtaaacagcaggatgaccaccacaaagagcacggtgagcacactgattttcaggttgtccccggtgaaggaggcggccagatcccgggcgttggtggaattgcccaccagcaccacatcgtctccgtagtattccgcggcaatggcgcggatctggtccaggagggcataggtctccgccccctcctcggggagatcggcagtaaagaccatccgggtccactgttccccttggagctgctggagtccgtcgtccagggtatcctgcagctcctccacctggctggcctgctctccgctcaggcggataacccccttgtccttctgctccagcaggaactggaacacatccagcaggggcacggaatagtcgtccgtgtcctgaaagatagcgccgtattcctccacgctcaggccgtaagcctggtagagcagccgggccagctcgatgtccacgcccgccagctcggcaaactgccggggggtcagcttgtcggtgaggtagcggccgtcctccacctcaatgttggccaagccggtggcggtcgtcacgttgtccagggcctccacccggcggagcaccgcaccctcgctgtcgtagtccccacggggaaccagtacggcaatggtgttggtatagccgaaggtctcgttgatcttgtccatggcaatacgggtctccggacggttgcctgagttggtggaattggtggagaatacatagtcgcactggttggagcagtaaatgccgccgatgacgcacacggcgaacaccgccggaagcacgaagcgcagcttcatgatgaggcggccccagcctgcgatggagggcactaggtttttgtggcgggtcttttcgatgccccggttgaaaagcatcagcagaccgggcatgagcagaaacaccgacagcatggagcagacaatgcccttggacaggacgatacccatgtcgaagccgatgcggaactgcatcagcatcagggccaccaggccggagatagtggtgagggaggaggaggagatctccacgatggccttgctcagggcggcaatgtccgcctctcgggcgtccagaccgttgtcccgctcctccatatagcggtggcagaagataatggcgtaatcgatggccaaggcaagctggagcaccacggcgatggcgttggtgatgaaggaaaccgagtcaaagagaaagttggtgcccatgttgaggatggcggagaccacaaacacaatgagaaagaccaggacctccagatagctcttggaggtgaacaggagtaccgctacgatgacggcggcggcaatggccagaatgaccgtcatctcctgcataaggctgtctgagtcgtacggatcgccgctggggaagacgtagtgatcgtagggcgctgccagctcctttacggccgcgagggcggcgtccgcctccggactgccctcctcaccggtaaaggagacggaaaagagggcggaggagtccttaaagtggtcggtactgtcgtcaaaggcgacggaggacacgccatccagctccgctaattgagcggctaccttttcggcttggcggtaggtcacattggagagcatgacctgagcggaggcgtaggtggtgaactcctcgtccataagggtcagcccccgtcgggtctcggtttcggcggggagataagaggtgatgtcattgttgaccaccaccttgtcaatagagctgccgcaaaagagtaccgccgccaggaagaccagaaagaaggcctttcgcttgtcgacaatgaaccgcgccagcttggttacaggggtttcagagcttgatgtttgtgacatgggtgggattccgcctttctaaaccgggagctcgggttgaggaatgaagtgctctacatgccgaagcagcacttcgtctggaacgtctgcaccgctggagagccaccagcggatcagggcgagcaggccgccggcatagaagcgggccgtcagctccgggtcaaacccggcggccggggcgctctccgacagcttttgcttcagcgcatccgtaatgatctcgtccagcacgtagaactctgctgcgccctggacggtgaggaacatccccctgtgggacttcaggaaggagagcgcgttgtgaaaaaggaccataaaatactcccggggcccggtacgtgggtccagggaggggtccaccggctcgaagtatttctgtagttcgtccacagcatagcgcagcagggccagcttgtcatcgaaatgggcgtagaaagtggtgcggtggaccatggcgcgctggcagatatccaccaccgagatttcactcagcggacgctcctccagcagggagagcagggcgtcggcgaggagcttccgggtacggcgctgccgcagatcttcccggggctggctggtttgtttcaatgggatccgctccttattctgggatgggaaaaagtgtagcacagacaaaaacaaatgtcaagataaacaacatatgtagattaagtgaaacacacggaactttttctgttgaggattatagggatacaaatggaaccgagctgtgcgagagggcggggaatgagagacaaccgccctctttatataattttataggtgcgcaaagtaggtttcgtgcaaaacaagtaaaccgaagccggataacccattgacgtagtaggagattgttgctatactaatttaatccatattgattggtgggaaagcttgcgctgcatggaagcagtgataagagaagaaaaaggaggggaaacgtgtggagctgaatgtggacgaggcgttgcgttatctgggcatcggcggacaagcagccgagtccattcgagcgagtgtggctgctgtcgcagacaagttaacggctgctatacagcccagatacacctaccgcgtgtgttcccttcaaaaaacagaggccggattcctgctgccggaggccgagctggtccttccgggcgcggacgcagcgaaaatgctggagcagtgcgatcaggccgtgctgatggcgtgtactctggggacacagtttgaagccctcttgcgtggggaacaggctcgtgatatgtccagggcagtcattctggctgcctgcggcagcgcctgggtggaggccgggtgcgaccaggtggagcaagaactggcgcattgtcttccgaaccgctacagaacggaccggttcagtcccgggtacggagatctgccgttgtctttgcagccgaagatctgcgccgcactggatacccaaaggcggcttggactgtatgtaacagagagctatttgatgaacccatccaagtcagtcaccgccatcatcggcttgtccgactggccccagatggcccgcatccgtggatgcgcatattgttcgatgcgtgagacctgcaaattgcgcgtgggaggaaaacactgtgggaattgagatacctcaaaacaaatttttgatcctggacggcgctatgggcaccgttctccagcagcggggactgtctccccaaggccggccggagctgctgaatctgacggagccggagctgctggattccgtctataaagagtacatcgccgccggaagccaggtgatttatgccaacaccttcggtgccaacggcttaaagctggccaagacgggccacagtgtggaggaggtcgtgggtgcggccatcgccgtggcaaagagagcggcggccggtaccgggaccctggtggcgctggatgtgggcccgcttggcgagctgttggagcctatgggtacgctgtcttttgagcgggcatatgacctgttccgcgaaatggcggaagctggtgcaaaggccggcgcggacttaatcgtggtggaaaccatgacagacctgtacgaggccaaggctgccctgctggcggccaaggaggccgcccacctgccggtgtttgtcaccatgtcctttgatgccggcggccggaccttcaccggctgtacggtcgcctccatggcccgtacactggagggcctgggtgcggacgctattggactgaactgttcgctggggccagacctgctggcgccgctgctgaaagaactgtgtgagaatacccgcctgccggtcattgccaagcctaacgcgggcctgccggacccggtggatggacactatgatatgggaccggaggactttgcccaggctctgctgacctgcgtggaggctggtatctccatcgtgggcggctgttgcggtacatccccggaatacattcgtcggctgacggcagttctggaaggaaaaaagcccgtatcccggcactataacaacaccggtcttgtctgtacccctgtgacacccatccgactgaatggtgtgcgggtgattggcgagcgtatcaaccccaccgggaaaaagcgtttccagcaggcgctgctggaaaatgacctggactatatcctggatgtgggtgtccagcaggaggatgccggagcggacatcctggatgtgaacgtaggcttccccggtgtgaatgaagtggttatgctgcccagagtggtaaagaagctgcaaagcgcgatcgctgtgccgcttcagctcgattcctccaacccggacgcactggaggcagggctgcgggtctataacggcaaggctgcggtgaactctgtcaacggagagccggaggttctggagcgtgtgctgcctattgtgaagaagtacggcgcgtccgtggtgggtctgacgctggataaaaacggcatccccaaaacagcggaagagcgggtagccatcgcccgccgcattctgcaggctgctttggaccacggcatccccagagaggatgtgtggattgactgcctgaccctgacggtctcggcccagcaggagcaggctgcggagacgttgaaagcggtgcggaccatccgggaggagctggggctgcaggtggtgctgggcgtgtccaacatctcctttggcctgcccaaccgcaagctgatcacgcagaactttttgattcaggccatgcatgccgggctgactctgcccatcatcaacccaaatcaaacggagatgatggacgcggtggcggcgtaccgtgtactctccggagaggatcgggagtgccgagcctatgttgcccgtttcgcggcggagtcccctgccgtgcaggcagcgccgaaggcggatgccctgacgttgggcgatgcggtcatccgtgggttgaaggccgatgccggaaagctggctgccaaagcgctggagaccgaggatgagctgtctctggtagaaaaccacctgatccccgcactggacaaggtgggagaggactatgacaagggtacggcattcctgccccagctgctcagcgccgcccaggcggcacaggcagtattcgaggtcatccggagctctatcgccgccaagggcggtgtgcccgtgaagaagggaaaactcatcgttgccactgtgcagggcgacattcatgacattggcaaaaatattgtgaaaaccgtactgggaaattacggctacgaggtgttggacctgggccgggatgtgccgccggagaccatcctgcggacggttcaggagcagggggtgcgcctggtgggcctgtccgccctgatgaccaccacactgcccgccatggaaaagaccatccggttgctgcacactatggaggagcccccggtcatctttgtgggcggcgcggtggtgacgccggaatacgccaaacaaatgaatgcggactactacgccaaggatgcccaccagtcggtggagatcaccagaaaggtcatgggatgatggatatccgcacctatttatcgcagggaaagccattgctgtttgacggggctatgggcacttatttcgccgcccatccgggccgggctgaggaacgctgtgaacgggccaacctgacccgcccggaggaaattctgcgcatccaccgcgcttatttgcaggccggctgccgggccatcaagaccaatacctttgccatcagtggagatctctccgatgggaacgatgaaaccgcctgcgacatcgtaaatgcggcctgccacctggcacggcaagccgctcaaccctatggggcttatgtatttgcagatctgggccccgcgccccgtgaccacagccgcgccccggcagatctataccagacgcaggcgcagtggtttctggaacagggggtgacccattttttggtggaaacgctgtctggtgacgaggggctcccggaattggctggttggttgaaggaaaaaaatccggatgcgtttcttatggtttcctttgccgtggaccatagtgggatgaccagcgccggacgtttgggcagcgagctgtatcgctttgcatcggaactggctggggtggatgcagtgggctttaactgtgtttctggcccccgccatttgctgaaatacattcagaccctggagctgagcgataagcctctgactgtcatgcccaacgccggttaccccaccgtgctgggccgccgcacggtattcggcggtcagcctgactactttgcagggcagattgcacaaatcgttcaggctggcgcctccatcgtaggcggctgctgcggtactacgccggaacatattgcccagacggcgcaggctttgaaagagccgcttcctaagtgcaccgtttctgctccgaaaaagctgctcaaacctgcggccaatgcgtccaactccctttgggagaagttggaggcgggtaagcgtgtcattgccgtggaactggacccacccgtagatgacgacagcgcgggcttttgggagggggtgcaggccttgcggggctcgggggccgatgcggtgacgatcgcagattgtcccatcggtcgcccacgggcggacagcagcctgttggcctgtaaaatcaagcgggatattggtatagagccgttgccccatatgacctgccgtgaccgcaatctgaatgctaccaaggctctgcttttgggcttgtccatggaaggggtacacaatgtgctggtggtcaccggcgaccctatccctaccgaggatcggaacgaagtcaaaagcgtattcaatttcaactcccgcaagctggcccgctttgtccatatgctgaatgaaaataccctgcgtaccccctttcgtatctatggcgctctgaatctgaacgcccgcaattttgatgtggaactgcggcgggcacaggagaaagaggcatgtggtgtttccggctttctgacacagccggtgttgtccgccgaggcgctggacaacctgaaattggcacacaagactctgcggggcaagattctgggcgggatattccccgtggtgagccaccgaaacgcctgttttctgaacaatgagatttcaggcatgcgggtgtgcgatgagatcattcatttatatgaggggaaggaccgtgatgcagcggaagctctggcggtcaccgtttcgacggcgattgccaaagagatcttcccctacaccgacggttattacctcatgaccccgttccgccgggtggcgctgatggagcatattattcaaaatattcagcaatcgtgcatttcataagcaaggaaaaggggccgttcgtgtgaatggctccttttttgctctggtcggttctttaacaggtctttataccagatcaatcaataatgaaattacctattgacatcataggaaataggtggtagtataatcccataaaccaactgagtaaattggttttagaggggcgtgcaaaatgagcaatctgtttcaacaactgttgcgcagcaatttccgctgtggacgaatgctgaactcccgggcactggatttggccgggtggatcggtatgtcctccactcactttgttgtgatttaataagatcattacatggccatatctctttgtccgggagcgaataacgccccggtctttttgtatctaaaatcaaactataaactgaaagaggtataaaccatgaataacaattataagtttgaaaccctgcagcttcacgttggtcaggaacagcccgatcccgctacggattcccgtgcagtaccgatttaccagaccacttcctatgtcttccgcaactgcgcccatgcggcggcccgcttcgggctgacggatgccggtaatatttatggccgcctgaccaactctacccaggatgtgctggaaaagcgcctcgcagcattggagggtggcgtggcggctctggctaccgcttctggtgccgccgccatctcctataccattcaggcgctggcccaggctggcgaccacatcgtggcgcagaagaccatttacggcggcagctacaacctgttggcccacaccctgccccagttcggtgtctccactaccttcgtcaactctcatgatcttacagaagtggaaaatgccattcaggataacaccaaggcaatttatctggagactctgggcaaccccaactctgacattccagacatcgacgccattgccgccatcgcccacaggcacggtctgcctctggtcatcgacaataccttcggcacgccctatctggtccgccctattgagcacggcgctgatattgtgctccactccgccaccaagttcatcggcggccacggcaccacactgggcggcatcatcgtggactccggcaagttcgactggaaggccaacggcaagtacgcgcccattgcaaaccccaatcccagctaccacggtgtcagctttgtggacgctgtcggtcccgccgcttttgttacttacattcgggccatcctgctgcgggataccggcgccgccatctctcccttcaacgccttcctgttgctgcagggtgtggagaccctgtctcttcgtctggaccgccacacagagaacaccaagaaggtcgtggagttcctcgcaaaccatcccaaggtggagcatgtgaaccatccctccctgcccgagcatcccgaccacgctctgtatgagaagtattttgccaacggcggcggctccatcttcacctttgaaatcaagggtggtcaggaggaagcccacaagtttatcgacagtttggaaatcttttccctgctggcaaacgtggccgacgtgaagtccctggtgatccatccggccaccaccacccacagccagctttctgctgaggagctgctcgaccagggcatcaagcccaacaccatccgcctctctatcggcaccgagcatattgatgacatcattgccgacctggaaaagggctttgccgctgtgaaatgctgattgcaaatttgaagtaaagcacaattttatgttttggaaaggattttgactatgatgtgtatgtgtcaaattatgcactgttataaaaatcgaatcatttccatacctcgcctgcgtttgatacgataggctgtgctttgtgtgcaattaagcggggtatccatgagaaacggatgccccgctctttattttctcacggaaggaaacgtaagatgcagtctatatatatttaaagaactgctatggaaaaattttaggtgcggacgatgtacgcacggaagcgtccccaaacgtaataattttttggaccggaaggattccagcgaaagaaggtatcagtttgaatgaattgcgtgatcaggtatgtgctgaaaaagaatatatgattaacttacgtcgggattttcaccgtcatccggaattgtccctacaggaaaggcgtactgctggggtgatcgaacaggagcttgagcggttcgaaatttcgcatactcggatcggagctaccggtgttctggggattttgcgaggcactcaaagcggcagcggagtcgtagccttacgggcggatattgacgcgctgcccattcaggaaaccaacgatgtggagtaccgttctcagacagacggaatcatgcacgcctgtgggcacgatgcccacacagcaagcctcttgggtgccgcgaaagtcctctcccaaaatcgtgaccgctttggtggagagctccgttttctgttccagccggcggaggagaccggcaaaggcgctccggattttataaatgccggagccctggatggcgcggagcgcattctgggcctgcacagtgctccggatctgccccttggcaccattggacttacgcccggactgaacaatgccgcagtggatcatttccgtatcctagtccatggcaaggcggcccatgtctccaccccgcagttgggcgcggatgccctgtatgccgccagtcagatcgtggtagcgatccagggactggttgcccggcgttcttcacctgtggagccagtgctcctcggcgtcgggaaatttgctgctggaacgacctacaatgccgttgcggaatatgcggagctggaggggaccacccgcacgatctctcaggagacgcgtctgcaggtgcgggagtggatcgaccagaccgcggagcagattgcagccatcagtggcgcggaagccagggtgatttggtcggatattacctccgctctgattaatgatccgcaggtcagccgtgaggcggcagaagtggcaaaggggctgggagaccatattcaggtcgtcaccaatcgccccttgtccctgggcggcgataactttgctgagtatcaacgttttgtaccagggtgctacgcctatattggcacagcaaacacagacttgcccagcacattgaacagcctccacaacggaaactttgatttggatgagaatgcacttgtcttgggagcaggcttatatgtgggatacgccctgtggtggcttggaaggcaggagaagccatgattcaattagaacatattagcaaacgatatgtcggccccagcggtacggtggatgcgctgaaggatgtgtcggttcatgtggagaaaggagatatctatgggattatcggctcctccggcgcaggaaaatccactttgctccgcatggtcaaccagttggaaaaaccggataccggcacagtcaccgtggctggccgggaactgagcacgctctccaaagctgagctgcggaagatgcgccgtaaaattggcatggtatttcagcagttcaacctattggagtccaaaaccgtattccagaatgttgcgattccactgatcctggagggcatccccaaggagaagatcactgaacgcgtcaaagaagtgctccatatcgtggagctgcacgacaaacgagatacttatgtcactcagctttccggcggacagaaacaaagggtgggtattgccagggcgctggcaacagaacccgcaattctcctgtgtgatgaagccaccagtgcactggatcccaagaccacagaatccatcctcggcctcctaaagcgcatcaacaaaaagatgggcgtgacaattctgctgatcacccaccagatgcaggtgatccagatgatctgcaacaaggttgccgtcatgggaaacgggcagatcgtggaacagggaacagtgttggatgtgttcagccagcctcatgctccggtgacacaggagtttgtccgcacggttatcaacgatcagatccccaagagcattctggatttgctccagacagaaacgcggcactacgtgattgaccggctgaaatttatcggcgccagcgtcaaaaaaccggtcatttccgagatttgccagattgccggcgtggaggttaatatccttggtgcaaccgttcaggagtttggggaaagcatcatgtgtattttcatcctgcaaatgtttggttccgatgacaagctgctccaggccgaagcacagatcgacgcggctggagttctccgcgaaagggtggtattcggctgatggaagctctgttggaaacaaagatttttaaggtatctgtcgagcgactgctgcttaatggcggtcaaacactatacatggtgggtattgcactattgattggcaccgtgatcggtaccttgctcgccttggtgctggtgctctgccgcaagggcggccttgtggaaaataaagttctacacagtatcgtcagcctctacatcaatgtggtacggagtgttccgttcatcattttgctggttaccatcatgccgcttacccgcgctattctgggtacgacgattggcagcacggccgctttggttccgttagtggtctatatcagtccctatttagcccgcttgattgagaacagtttgctggaggtatccccaggcattctggaggcggcccaggccatgggagccacaacctggcagatcatccgctgttttctgatgcctgaagcgctgggttcgatggttctggccttgaccacaggaaccgtcggcctgttgggcgcctccgctatggctggttactgcggcggaggcggtatcggcgatctggcattgacctatggttatgaaaagatgaataccccgttgatgatagttactgtcattgctctggtcatcctggtacaactattgcagatggcaggcaaccgtgtttcccgccgtctgcgtgagcacagataatgtgtgattcatattagtgtcgagtcgtgaaagaaggttaatcctatgaagaagttttttgcattggtagtgtccctgattctgattctgagtttgactgcctgcggcggcagtgacagctccacggacagcgcaccggcctctggagcatcctccgccgatcccgccgcaaagacggagatcgtctacggcaagtctcaaggtccctacaccgaattgttcgaagcagcgatcgttcccatcctagaggagcagggctacaccctgaaaggagtcgacttttccgacctgctgactgccgatatcgccctgaacgacggcgatgtggatgtgaacgtggaacagcacacggcatacgccgaaaactttaactccaataacaacggtgatctggttcccatcagtcccatccctaccgttcccgccggtatttactctgggacccacacatctctggatgaagtgactgacggcgcaaaaattgccgtccccaacgatgcctccaacaccgctcgggcctatgtcctgctgcaaaagatcggctggatcactctggatagcggcgtagatccctctgccgtgacacaggatgatatcgtggagaaccccaagaatctggaatttgtggaaatgaagtctttaaccatccccgcagccatccaggactttgactatgtaatcattaccggcagcattgtttacaatgccgggattgacccctctgctgcactggcaaccgaggacattcttgatcaccttatcctacaggttgttgtcaaggaaggaaacaaaaacgctgactgggcgcaggccattgtggacgcttatcactctgaccgatttaaggcctatctggaggagaacaacgacggcctgtggtgggttcctgaagaactgcagtaggaagatgtcagctaatagagaaaagagtgccctgattgcaatgagcggcggtgtggacagctctgtcgcggcatggctgatgcgtgagcaaggatatcgctgcgagggaacgaccatgcgtctttaccgcaacgcggacatcggcttgagtcagttccatacctgctgctcgcagaaggatatcgacgacgccagtgaggtggcgtttcaactggatattccctatgaagtgctggattttaccatggacttcaggaaccagatcatcggaaagttcatccgaacatatgagtcgggcgggacaccgaatccatgcattgattgtaaccggtatatgaagttcgataaactgcttcgctttgccgaagagaagggactggagtatgtggccaccggacactatgccctcattgaatatgacgaagtgtccggcaggtatcttttgaaaaaagcgctggatgacagcaaggatcaaagctatgtgctgtatatgctgacacaggatcagcttagccacatacagtttcctttgggcggcaaaatgaaaaaggaagcgagagagatcgcggaacagttgggcttctgcaacgcccggaagcacgacagtcaggacatttgcttcgttccgaacggggactatgtcaagtttatggaacagtataccggaaaacaatacccggcaggagcgtttcttgatctggagggccagacggtcggcagacattgcggggctgtccgttacaccttggggcaaagaaaaggacttggtcttgccatgggtgaacctgtgtacgtttgcggaaagaatatggctgccaatacggtcacagtggggccggaaaacgcgctgtatagcagtatgcttcttgcggaagatatgaactggatctccatcccgcaattaaagcagcccatgcgggtgaaggccaaaacccgatatcgtcaggcggaacagtgggctgctgtgtacccggagcaacacggccgtgttaggctggaattcgatgtgccgcagagggctgttaccgttggacaagctgtggttctgtatgatggagatgtcgttgttggcggcggcacgatctgccaggcgccgccaacgaaacgctgattcacaaaatacaggctcaggcttggacagccatatgttgaacggtggacatgaccactgcggcgcctgttgctgcggaagctgcggtgcgctgaaactgacccaaacagaggtcgatttacggcgtctttctgctcagattccgagtggaagtatggttctgaccacaaaaggtcaggcagtgattgaatgagtggaaatacaagaattgaggcataagcaacgatgctgaatcaatttttgaggacacagcgtctcttccaccgggaggacatggaaaaactgtatcagggccgggctgctgggggtggtattggcggcgttggcgaatttggtctcattgatgatggacgggtgtgccggacaagtgtgaatcgccacacttttgcaaccagaaaaaccgtggggcagaaagtgtggaaaaggtgaaatccgcttaactgaacgttcctgtaaggagctttgcggacaacattttaacgagagggattactttaaataatctcccggttggaacaacgctttaagctggtgatacccaattgaggattacttaaattggcggtgagttctatgcaagctgtgtgatttggcggcggatcggagacagtgtggcgccgggagaaggttttcgccattgttttgcaggaggggatgattcactctggagacaaaattacagttttaccggagagacgccatgatttaccttgactactccgccaacacaccggttgatcctgctgtgctagaggcattttgtaaagcggagcaaacgtatatcggaaatccgaactcaacgcattgcgctggacgtacagcctgcgaggagatggcccgagtgacagatcatattgctggacttctcggtgtggaacccgccgggattatctacacttccggagccagcgagtcgaacaacctggcaatcaagggaatcgcccaggcttcccgaagtaccggcagacatatgatctccaccgtactggaacacgcatctgtgggcggcacacttacggctttacagcagcagggctgggaagtagatttgttggatatccagcgggatggaaccattgacctggagcaactgggtgatctgctgcggaaggacacgatcctggtgtcagtctgcgcggtggacagtgagctggggacagtgcagccaatccgtcaaattacggagattctaaaagattttccaaactgccgtcttcatgtggatgccacccaggcgataggaaaaacggagctggtgatggatggtgtggacaccatgagcatcgctcctcacaagttttacggtctcaacggcagcggacttctcctgaaaaagagcagtgtgattatcgagcctcagattcacggcggttccagcacaacgctttaccgtagtggtacaccggctttggcactggctgtttccattgaaaaagcgcttcaattgacgctgacgcagcaggaagaacggatccgctgtgttcggcagttgaacgaatacctaaagactgcactgctgcactatccgtcagtccggatcaacagtccggaaggcgcggtaccgcatatcctcaacctcagcgttcaggggcttaaaggcacggtatttcaacgtgttttgagtgagcggggcgtatgtgtttccgtcaagtcggcctgttccgcggaggggacgccatccaaagcggtatttgccgtcagcggggaccgaaaaaatgcgctgtcctcctggcgagtgagcctcagtcatttgacaacacgagaggagcttgacgaatttttgcaggtgttcgaccaatgttacaaagagttggttccatgaaaaatccattggactatcagatttcgaagtatgactgcggttccaccgctatgctcaatgacgcgagctttcggttccaagggaaagatatccccctgtagtttaccagtaatatcaccctgtactgtttggattgttacggctcagatggagtttgcgaaaagggtggaacctttttgcggagaacggctcaatctgtgacaacggaggcggcagttctaaacgtcaggaaaacaaaacactgctctgtgggttgaaacgaagcaatcccggcattaaaaagagtatattcaacaacatccacgctgttttccagatacggtgcccggttgcaaaaaaacggtacagagcactgatttttggagcaatatgaggaaaaatgagccggtaggatatcctaccggctcattctgttacctaatcaaattacataattatctccagcagcaccggacttcattaaatctgcaatggtaacattgtccagatattcgttaattactttatctagaccctgccacatatgtaaagtgcggcattccgctactctggcacagaccgctgcgcctggtccgagacaagaaaccggcgccagggagtcttccgtaagtcgtaaaatagcgccaacagtgtactggtcaggcgactttgtcaatttatatccgccgcccttgccccgcagtccgctgagaatatttgctttgacaaggagcctgatgatggtttcaagatatttctctgaaatatcctgccgctgagcaacttctttcagtgggatatagccgtccgtctggtgctcagcaagatcaatcataacacgcagtgcataccgccctttcgtagaaatcagcattttaaagtctccttgcactcattataacctattatagcgcatggttaataggaaaatcaatagcctttttggagcggtcctattgacaaaatgagcaatatctatattttgaggaccaattgatcgggaaaacaccgcctctgaatctcgtccctattgagcagagcgaagggctggaggccaacctgctcggcaaactcgaatacttcaatcccgctggcagcatcaaggaccgtatcgcaaaagccatgatcgacgatgctgcggccagcggaaaatgaaagcccggttctgtgatcatcgagcctacctctggcaatagtaaggggcttggtcaatccgaaggcgtttaggctggcatctcttccggtgccgcggtttgggctgcgctccaacccgtcaagcggcccgaaaatagaggcaaggaccatcacggcattgctgccggatacaggtgaccgttatctctctactcctctttttgcggactaagaagataaaaaagatagtaagtcaacttcatgacttactatcttttttgtttacccgtaccaactgcgttgtccggaggtcgcattgtgtccctagaagaattaatccctggtccggggggcttctgtgcttagttgtgggattctgtaaagcgcatgagaatggcggccatctcggcacgggtggcggtgccggcggggtcgagccaaccgccgcccttgccggtcagcagaccctcgtccaccgcccagcacagggcatctgctgcgtaatcgctaaccgcgtctttgtcgttaaagccgtccagactgcccgtgggctccggcgtgcccgcatagcggtacagcatggccgccaactgttcccgtgtcactgcgtcctccgggccgaaggccccggtgctgtacccggtcacaatcccccgggacgccgaccagttcaccgcaccggcgtaccacgcgtccgacggcacgtcggtgaagcctgccgtaccggggacggcagggctgtccgccaggttccagagcacttgggccgccatggagcgggtcagcactgtagtgggcgcaaaagcggcggggccagtgccgtccatgaggccgtttttatatacatagaccaccgcgtcatagtaccagtcgccgctgctcacgtcggcaaaggggagtttgggctcggcttcaatttttgcgaagctcgcctcaatctccacactggaggcgggcattttaaaggtgtatttgccgccaccctcgttggtgagcttgatttcgtcgccattcttgccggtgacaaccagtttgtccagctcatagccctcgttgggcttcacggtgatggttacggtgtcgcccttttcggcccgcttggggctgacggtgacggagccgttttttccgctgtccacgctgacggtgaaacggccggagctgaagcctccgccggaggagctgggccacaccacagccgtacctgtggccttgttgtagtggtcagtatcatctggggtaaaggtccaggcgtaggacttaccgcgctccaaggtctggtcgccatcatcccaggagaatgtacccgcgacctcaatacccgccgcgttcttcatggagccggacagggtgatggtagacagctccacgccgctgctgaccttgtcaaaggtaggttcgcccttgggatttcccatgacgatgctgtatcgccgggaggcgtaacagtaggtcttggtgtccttgctatacccattgatgacaaaggagtagacgcccagctcggtgggagcgatggccttgagtgcatcggcggtcagatgggagtttgtctgattgtacaggtgcgttccgctaaaggcggtgccctcttgtactgcgtggaagtgggcggtgaaggatgtgatggaatggtcagtgcttgtgcccttggtgtacagggtggtcaggttacgggcggtggggacgatgccctggccggtgtactcgtacacccggtctccctcaaaggtctccagaggcttgtcatctccctccagatagaggtctacctcattcatgccttcctcatagcaggtaacatagaggatgatggtgtcactcggctgccaattcgtgcccacggtgcagaaacggtagttggggtttttcagcttcagctccacccggatgctgtgggggttgccctccgcatccgtggtggggtgagtaggcagggttccggtttcgatgatattgccgctggcaccgccgccctcgttctggtacttgtaataaacatcgccgtcatcgcccatgccgggcttgaggtcgatcttgtccttagcgatatcagcctcgtaggttccgttctgactgccctttttcaccggatagaagcccagcaggtcactgaacttgggcgcggtgccgtcctcattcagcgcgtaggtgatgtacggacggccgatgccgccgtcattctgcgttgtgtctgccttgccgtagatgatccgcatgggggtgacttccacattgacggtcagcgtccctgtgacgccagcctccgttctggcggtggcggtgatggtggttttacccaccttgtttgccttgagctgatcgtcctcaatagagacaatggtgctgtcactggactgccagttggagagggtgacgccctcgatggtcgggagcgtctgggtggagccgtactccatggaaatagcatcggatttcagctcgatccacttggcgtagtaggtctctcctgctgtggaggtggtcacagcggtaccggtacaaccctcgtttttgtaccagccatcaaagatgctgccctctttgatgggagttgccagtttgccagactcaaacttggtgtccgccgcaaaggtgccgccatcggtaacggccagagaagttttctctgaatcgaatccattgcttgttgaggttggattagcctttgactgcaacatcaaggaaattaaatcgcttgaacccaaataaattacactattatttgccatccctttaaaaatttgattattttctggaatagaggaaaccgatgccggaatatagacaccctccattaaagatgcatccttaaatgccatgctaccaatagtgttaaggttgtttgaaagaaccactcttttcaaattagtacatccttgaaaagcactctcggcaatttcggtaacagagcttggaatgaggacttcttccagcttagtacaccccttaaaagtctccttgcttatttttgtaaactgtggattttctggaaaaacgaaactttcaagctgtatacagttactaaaggcaccaggagcaatcgtcgttaccgtatctggcagagtaatgcttgtcagagaactgcactccataaaggcattaactccaatttcagtgacggctccattaaactcaatgctactaatgctcgtcgctgcaaatgtataggatgggatggaaaatacgccaaccggaacagaaatcgttccattcaaagaagaacatttataaaatgcttgtggctcaatagtagtcagatttgctggtaatgtgatggaggtaattccagaaccataaaacgaatcttgcccaattttagttatagaggccggaagaactaccgtcttcaaatttgtataattcttaaacgatttcgcgccaacagaggttactccgtcttgaattactactcgagtaatcttctcgcgtgagtagtgccattctggctcgccactactcacattgtcttccgtgatataagcatttcccataggaccattaccgaaaattgtgagagtataaccatcctcatcgttcgctgtaagtgcccatttaacagtatcggtatattccttgtttatataatcatataggccgcagttaccggacatcacattgtcagcgggggcgggatcatcctccgtggtctccggttcatcgggcaggacgcactcacacttatgcccggcctgcagggtacagccctcggtcacggcgcaggcaaccggcgtctcgctgcccttgtctctctcggctgcaagggcagaaacagggaaaagagacagtaacagtaccatcgctatcatgcttgctagtagtcgttttctcatttgatctattctcctttatacaaaagtagtacctttctaaactgtccgctttgtaaaagtgtacctttctaaagcgcaattttactgtttgtatttgctgaaaaagtattgaaaatcctggaagacttgtgtatcatacaaacagggatcgttctatctgaaagtttgtaaaggtacaccttttcaaacaatgcagcgcctctggagaaatccagaggcgctgctgtcttcctgtcgcggacaaaattgtttgctcttatcaacttcgtgatggaaaatgctcccttaactgttgcaaattcgtgaattatatggtatcattttacatgaaaagacattggaagtaaagggtgttgcacgatgaatgcaaaactatccaaggtcaatcagtccattgaaaaaaccattcagattgtggaggttatggcccgcggtaagggccctatgcggctgcaggacgttgctaagaaatgtggaatgccggccagcacggtgatgcggatgcttaatacactgcaggtgtacggctatgtcaatcaggatccctgtacgcagcactactctctgtcgctgcggtttgcgcgcctgggttgcttggtcagtgaacagaccaatatgcgggatgtggcgcggccattcctggcagagttggcgcagcgctgtcaggagactgtgtgcctgtggtgtgaggcagaaatggaagtggagtgcaccgatgtggtggacggcccggacggaatcctgatggtgagccagcgggtaggcgcacgcgccccgctccacgccaccggtgcgggaaagctcctgctgctcaattacagtaaccagaagctgaacgagtacatagcagttaagggcctgcgggccctgacgccccatacactggtcacgcgggaggcgctggtgaacagcttggagatgatacgcagtcggggctatgccctggaggacgaggagcgggagctgggtgcccgctgtgtggcggcgccggtgcgtgattactcggggcggattgtaggcgggatcagtgtctcaggtcccaccacccgtatgtccagggcgcggctggaggcgctggcacccctggtaatggatatggcagcggaactctcccgccggctggcctatgaggagtggcctgaggaaggggattgactttcccggtcgggcggtatatgatggaagcacagttgaatatcgaactccggcttttgtggcatttacgcgaccccgcctgtccgggcgggacacgtattcttgttcgctgaacaagggaatcaggtgaaattcctgaacacggcccagctccgctcggtgcggatgggtacgtagctgtaagcacggagcgtatcctctttccgtgaaagcgggtcactggcttgtgctgggaaggcgggggatatgcgctggcggcatagccgtctggacgtgtgagtcagaagacctacaaggagcagtttctccccgagtggaggggagaggcatggtgcgtacaaaagcggtaacctgaggttaccgcttttttcgacctgctcccaaggtgggagaaagcggatacagaggtatccgctttttcatttcgggatcgacggttccgcttaacaggtgaattccaggaccggccaggcggccgcccggacattggggagaatggaacggggccgcagactcccgacggaacgcgcagggcctgcgaatgggttggggcggggagaacagctccccggacaggcgccctgccggctaggctggcagggcgcctgattcatattaaataaaaactccgcaaccgaaaggttgcggagttttggcggagagagagggattcgaaccctcgagacgctattaacgcctacacgatttccaatcgtgcgccttcgaccaactcagccatctctccatggtgagtgctctatccttgctcgcccatcagccgagcagcagagattattatatcagctttttcgaatacgtcaagaggaaaattgaaaaaaatcaaaaaaagagggaagtcaggaaaacattgtgccttgccaaggggaggggagagcggttacaatctggttacaaaacaaagaaaggttgtggaaccatgaaaaagctggtactggccgtggcattgagtgcggctctggtgaccaacggacaggcggcgtccgccggcccgctgcgggtcaacggcgcaccggtggacgccagcggcagctatgtccatcaaaacactacctatgtccccctgcggacgataacggaggcgctgcgccccgatgcagaggtggattgggtgaaagaccgggctgtggtccgggcggaggggctgaagctgacggcccggccgggtgatgcctacatagaagcaaatggccgtacgctgtatgccaaagacggcgtccatttgaaggcggggcgtacgcttgtgccggtgcgggtgttggcagaggcgctgggcgccaccgtggactggaatccggccaccggcgtggtgtcggtcaacgggggaggcagcgcaacgacgcagcccgactacaaccgggaggacaagctctactggctgtcccgcatcatctcggcggagagccggggagagcctctggagggacagatcgcagtgggcaacgtggtacttaaccgggtggattccccggacttcccggacaccatctacggtgtgatctttgacgaccggtggggtgggcagtttacccctgtgcgcaatggcacaatctatcaggagcccacggaacagagcattcaggcggccaacctctgcttggagggggtcaacgtggccaaggacagcctgtacttcctggcgccggcgctgaccaacaaccattggactatggaaaacagaactcacgtcatgacgatcggcgcccactggttttaccgctgaacgcggtggagacacgtccggacagctttccggacgtgtttctttttgttatcatttgtagccgaaggagagctggaaacatcgaaaaatgttctgacgcgcaaagagaagggtgaattgaaaccattgcagcacaatggattgaacagtatcgacaaaacttcctcttgactttttaggggagaatcggttacaatacggttacaaaacagtgaacaacaagtaacagattgtaacaggaggaatcctaagcatgaagaaacgagccctttgtgcgctcgtcagcctggccctttgcgttaccctggccgggcaggcggcggcggctgagagcagcgtcagctttgtagtcaatgggatcacccttgcggcagatgtgcccaaccgtgtggaggcgcgcactacctatgtgtcctactggcccatcgtgagcgccttgtatccgaacgcgacggcggagtgggtcaatggtcaggcagaggtcaaggccgacggcctgaccctccacatcaagcccggcgcccagtatatcgaggccaacggccgctacctgtacgtgccggacggagtcaagtgcgagggctacagcatcatggttcccatccgaaccctgtgccaggcgctgggcgccggcgtggagtgggacggaacccagtccaccatccagatcacctccggcagcgggcccatcctctccggtgagcaggcctaccaggcggacgtggtgtactggctctcccgcatcatctatgctgagagcggcaatcagcccttggacggaaagattgcagtgggtaatgtggtgctcaaccgggtggccagcccccggttccccaacagcgtctacgaagtgatctttcagcgcaaccagttcacccccgccgctaacggaagcatcaaccgtacccccagcgctgagagcgtggttgccgccaagctgtgcctggacggtgccaacactgcgggcagcgccctgtactttgtgaatcccaccgtggcccccggaagctgggcctcccggaaccgcccctatgtggcgaccatcggggcccacgctttctacgggtaaggcgcggcaaaaagccgagaccattggtctcggctttttattgtgcaaaagcacagcaaaatggccatgtatcgccatatttgcctgttgtcatgatatgtgcatcgtgtatgaaatgtcccgaccgggaactgcgggagaaaaggatggaaatatccacgcgcgtatgttaatataaatacgtatgtccaaatgattcagcatggagggaactgactttgacttattttatgtccatcttaatggggattatccagggcgtggcggaattcctgcccatctccagctccggccatctggccctgtttcagacgtttttcgggatggagaacatggaggagaaatacatgttctttaccgtcctgctccacttcggtacactgatttctgtctgtatggtctactggcgggacattgtggatatgatccgcgagttcttcctgggcattgccgccctggccgggcggaaggataccggcgttgccccgccgccggcccgacggatggtgatgctcatcatcatcgcgaccgtgcccctgtttgtgatggtgtttttgcaggatgcggtgaaccaactgttctccaactccatcatggtttcctgcgccctgctggccaccgggtttatcctgtttttctccgaccgcatggcccggggccacaagaccgccaaaaacgcgacggtggcggacgccttgatcgtgggctgcggccaggcgctggcggttatccccggcctctcccgctccggcaccaccatctcggttggcatgatgcggggctttgaccgggccttcgccgtgcgcttctccttccttatgtccctgcctgccgtactgggcgccaacgtcctggaaattaaggatgcgctggcctcgaacttccccattgaggagctgcccatgtacttagtgggcgtagcggtgtccgctgtggtggggtactttgccatccggcttgttaagagcctgtccgataaggggaaattcggcaagtttgcttactactgctgggcggttggcctgggcagcttggtagcgggcatcgtgaagatgatgctgctcaagtgacagaaacccgatacaaaagaatgaccctggaaaggatttgattttcaatggccacagcacagaagaagaacgcgggcggaaagcggacggcctcgggtacgggaaggaccgcatccggctcccgcgctgccggcagccggaagaaggccccggcgcccaggcccatccgtcgggaggtgggggcggtggcctgtctgctgctggccattttctccgcctttggctacttccatattcaggccatctttatcgactttttctgcggcttggtcaagggcctgatcggctacggctactggctgctgccccccatgctgctggtggccagcgggatcttggtcttccaccggggccgcccggtgcggctgcgggtgtggtgcgccctgctcaccccagtgctggtgggctgcctgctccacctgattctgaccaggggctcctatgagtggagcctggagctggtcaagaccctgtggagccagggagaggctctcaagagcggcggtgtggtcagcggctcgatcgccctggggctgactgcggtgttcagcaagtacggagccggtgtaatcttcgtcctgatcgcggccatcatgctgatggtggtgttccacgtctccccggtggatatcgtggaccggatccgtgagcggccccgggtggagtacgaggaggaggaactgcccgagcccaagccccgtgagcgccgccgtgcccccgagccggagagcgccgcccgccgccagcaggtgcctcagatcgatatccccgtggacgatggtccgctggtgggcaaacggcccgagcccaagcccattgagaagaaggagcgctttttcaaccggaagccctcggtgcccacgccggaccaggtattggccggtgcggcggctggggatgtgcctgaggcagaactcattgccgtgtccccgccgcctgagacgcctcaggaggcagttcaggcggcgaaaccggtgccggaacccatcccggagcccgcccctgccccgccggtgccggagattgagcgggagcccgctgtggccaaggtgaagagggaggaggctgcccaggcggcggccgaggtggcccaggacatcgcccgcaaactggaggaggggactccggcggcctaccagtatccgccggtttcgctgctgaaggagggggcaggcgtgtcgggcgccgacgtggccagcgagctccaggccaatcaggcccgcctgtccgacaccatccggtccttcggcatcgatgctaccatcgccaatgtgacccgcggcccatcggtgacccggtacgaggtggagctggaccagggggtgcggcttaacaagctgaccaacctggctgacgatatcgccctggccttgggggctaccggcgttcgcatcgcccccatcccggacaagatctccatggtgggcattgaggtgcccaacaagctcgtctccccggtctatatccacgatgtcatcgactccagtgagttccgggacaacccctccaaggtttcctttgctgtgggccgggacatcagcaaccgcaatgtggtgggcaatattgccaagctgccccacctgctcatcgccggcaccaccggctcgggcaagtcggtatgtaccaactctctgattatctccctgctctacaaggccacccctgaggaggtgcgcctcatcatggtggaccccaagatggtggagctgggcatctacaacggcatcccgcatctgctcattcccgtggtcaccgaccccaagaaggcggcgggcgccctccagtgggcggtggtggagatgatgaagcgctaccgggccttctcggagatcggggtgcgggatctggccagttacaacgcccacgccgccaagaccgagggcatggagaagatgccccagattgtggtggtcatcgacgagctggccgatctgatgttggtggccgccaaggaggtggaggagtccatctgccgggtggcccagatgggccgcgccgccggcatgcacctgatcatcgccacccagcggccctccgccgacgtgatcaccggcctgatgaaggccaatatcccgagccgcatcgcctttgcggtggcctcctccctggagtcccgcatcatcctggacaccaccggcgcggagaagctggtgggccggggcgacatgctctacttccccctgggcaccggcaagccccagcgggtgcagggctgcctcatctccgacgaggaggtggccgccgtagtgggctttatcaagcagaacagcggctcggccgagtattcggaggagatcatccatgagatcgagcagcacgccgccgagaaggagaaggggagcaagggcgtgggcggctccgcgccggacgaggtgggggacgactacgacgagctgctccccgccgccattgaagtggtggtggagaccggcatggcctccgtgtccatgctccagcggcggctcaagctaggctactcccgggcggcccgactggtggaccagatggaggagaagggagtggtggggccctttgaaggctccaagccccgccaagtgctcattaccaaggatcagtggcaggagatgcagtttaagcaggggatggtggacgctgccccagagcccgtccccgacgagctggaatttgagggcgacgccatcccccagagccgggatttgcccccgtttgatatggaggattgagagcgatggagcactatgtcatcaagcccgccggggaggcgggggaagcggcggttcacgccggcctgcgggcctataaccgcacctttgtctccgatacggcggatctctccctggtggtggaggacggggccggacagatcatcggcggctgcgatgccttccggatgggggagctggccctgctggacgtgctgtgggtggcggagtcccgccggggcaccggcctgggggcctgcctcctggcccagctggagcaggacgccgcccgccagggtgcgaagcgcctggagctgaacacctttggatttcaggcccccggcttctatgaaaagctgggctaccgccgcttcggcgcagtggagcccgccgtgggggagtacggccactacttttacgtgaaagagctctaacaggacgcagataagccggatgggcgcggtcaaacgaccgcgcccatccggcttatgatgtagaaatggaggaaggaagtagaaatcagaatcagaagtcgacctcagtgccgtagtagatgcaggtaaacagcttggccatggtggcgggatcgatggggcgggggttggagccggtgcaggcgtcgcccaccgcgttggcggcgatggcatccagcttctccttgaactcgtcttcaataatgccgaagtccttcagggtgttggggatgcccatagcgtcgttcatggagcggatcttggcgcgcaggccctccaccagctcggcggtggtgtccccgacgacgcccatggtgcgggcaatgtcggcgtaccgctcggccacgccatcggccttggcgttgtaggcgatgacgtagggcaggtacatggcgttggccaggccgtgggtgatgtggccggtggagaaggccgcgccggtcttgtgggccatggagtggacgatgcccagcagggcgttggagaaggccatgccggccaggcactggccgtagtgcatctcctcgcggcagcccatgtcgccgttaaaggagcggagcagatccttctccacgatgtggatggccttgagggccaggggatcggtgaacacggtgtggagggtggacacataggcttcgatggcgtgggtcagggcgtccatgccggtgtgggccactagcttggggggcatggtctcggccagggccgggtcgatgatggccacgtcgggggtgatattgaagtcggccagggggtacttgatgcccttctggtagtcggtgatgacggagaaggcggtgacctcggtggcggtgccggaggtggaggggatggcgcagaacctggccttctggcgcagctccgggaagctgaagggggtgatcagatcctcaaaggtggtctccgggtactcgtagaaggcccacatggccttggccgcgtcgatgggagagccaccgcccatggagatgatccagtcgggttcaaactcccgcatgaccgccgcgccgctcatcacggtttccacagagggatcgggctctacgttctcgatcaggcgggtctcaatgccggcctccttcagatagcccagggccttgtccacaaagccgaacttcttcatggagccgccgcccagcaccagcaccgcacgggtgcccttcagattcttcaggttctccagggcgttggcgccgtagtaaatatctctgggaagggtaaaacgggacataacaggtacctccggttgaatgtgatttgacatcgttaaaactttaacgattcttcggaacctattatggcacattgttaattccctgtcaatcggttttgcagaaactgtacgttccaaacttcgcgtttcagatcaccagcgtcccattctcgtcctcctggagcagcagaatgcgctcctggcggccatcggcggcatccacgtagaccagcacgtggccgccggaggcgttctggcacttgaattcgtggcacagcacctcgtactcgccgccggtggggatcagggcgagctggtgggccagaacggtgagggagccgtccacctgggcggccgcctccgcctcggagacggcgggggcggggagggtacggtccccgtggttcatgaggtagccctccgactcaaagctcaccacatccccggtgtccagcgccacacccaccttgaccagatcggggtagcagtacacgccgtcctggcgggaggcaaagtggacagtgagtatgccgccctgctggatggagtagctggggtccatatcctggtagccccgctcggacagaaactccgcagccttctgccgcccctcctgggcggagagggacgcctcgcccaccggccgggaggagagtacctggagcacctggccgccctgccgggtgacctctacatagagctcgccgccattcaccagggcggagaagccccaggtggggagctgtccctcgccctgggcgctgagggtgaagatgtcctcccgtagccccagaaaggccgccgcggccctgcgggcctccgcctcggagacctggggcagcccctccagcatcttgggcgtgcggcccgacaggtggtcggaaaaggggccgtcgtagatcagggcgggcacctcggggaagtcggcctccaccgtctggaaggccgagccggcggggagttcacccgactccgtggcattggacagccgtgcctgaacggtctccacatcctccggccggatggtgcccgcgtccagctccgccagcaggctctggagggcgccggacagggtggaggcggcccccgccaggccgcgcagggtctcccggtgcgcctcggtgcacgccgtctcgccgtaggcgtcccgggccagggccatggcgtagtcgccggttttggccaggaaggcggcggtttgctccagctctacgttgccgtagggcagctcgcccagagccgactgagcggccagcgccttgctgtaggcctgggcgcacagtgcggagaacagctcgggactggtggcgtaggtcacctttcggagggcgacatccagctcgcccgccgccgtggccagctcggtgaaggcgtgctgataggtgttgtccagcatgcgccggtactgtgccgcccgggcgtggccctgtactgcaaacccggcggtcaccgcgaaggcccccgccagaaagctggcggccagcacctgttttctccgtttctccatgacaaaacgcccccttttacggctaggttgcgtaaaagggggcgttttatgtgcggtaaatataagctaaagaagggggcgaagccgcgcaaaaaggttgagcagatcatcggaggccttcacgcccagaagaggaatttccaagccggccgcctgaatccgatcttccagcgcgccgaggaaaaggccacggccgggcatctcttgattgcggtcggacgtggtttccactccgcagttgggggagcggtttgcgcccagaaacgcaacgatgcgaaacccgtatctgtggtactccagcacctgatgcatgacagattcaactaggtcctccagtatccggctgggggcgggcgcctgcatggcggcacgaatacgggtgttttcttctgtgaccggggactgcgcgcccagcctgtttccacggtccagcccaaggcagcagagctccgggcagggaagctgaacgattcccacctgatgttccagaaagaactgcaccagctctcggaaagcggccggatatacagcggttccgtcggagatggcgttttggttcagcaggcagtgggctagaaacaccacttttctactgcggccgtcggcaaacatctgcatttttctcaccattcacggctgggctcagccgcccagcttgtccagcccaagacggaggcggcgcaggcactcgtccttccccagaatgtggcagatctccaccgcgccgccgggggtgaccgccttgcccgccgcggcaatgcgcaccggccacatgagggtggcgtttttgacctccagagactcggccaggccgatcagagcgtcatgaatcccgtccacggtccagtcggccagcccctccagggcgggaaggacggcctccagcatccgccgggacacctccggattggtcttggacttcttgttggtgaacagccccgcgtcgtagtcgggcagggcgtcaaaaaagtccagcttctctgggatgtcggtgagacgctcgcaccgggcctggagcagcccggcgatctcctccgtggagagggcgggattctgcaccgcctggcggatgtagggcagggcggccgcatggaaggcctcggggctcatctcccgaaggtagtgggcgttgaagtaggtcagcttttcgatgtcgaagatggcgggggacttggagatgccgccgatgtcgaaaatctccgccagctcggccagggtaaagaactcccgctcggcgtactcgcctctgggagaccagcccagcagggtgacgtagttgaccaccgcctcggacagatagcccatggcgatgagatcctcgtaggaggggtcgcccttgcgcttgctcatcttgttgtgggcgtcccgcatgacgggggagcagtggatataggtgggtacgtcccagccgaagccctggtacagcagattgtacttgggggcggaggacaggtactcggaaccccgcaccacgtgggtgatgcccatcaggtgatcgtcgatgacgttggcaaagttgtaggtgggcaggccatcccgcttgatgagcacctggtcgtccagtgtggagttctctacggtaatgtccccgaatacggcgtcggagaagacggtggagccctccgcggggatcttctggcggatgacgtagggggcgccggcggccaccttggccctggcctcctccaggctcatgtcccggcaggggtcggccgcccggtcaaagttgccggagtcctcctcagactcggtcttttcgcagaagcagtaataagcgtggcccttctccaccagcagctcggcgtacttgccgtacagcgcccggcgctcggtctggatgtagggtcccaccgggccgccgatgtcggggccctcgtcccaggtcaggccgcacttgcgcagggtggcgtagatgacctcggtggcgccctccaccaggcggccctggtcggtatcctcaatgcggaggatgaacttgccgccgctgtggcgggcgatgagccaggtgtagagggcggtgcggaggttgcccacgtgcatgtagcccgtgggggagggggcgaagcgggtgcggacgccgtccttggggatgcgggcttccatctcctcaaaccagttcagatccattgaaaagactccttttttaaacttcatcacattattctatatttttcgcctaaggattgtcaaggccatttggatatgatatgataaaccaatatggggcattgtacccaatgagccaaaaatcactcgtaagaggtgtgttttagaatggaaaaccagaaaaaagtcatgctctccggcatccagcccagcggcgagctccacctgggcaactacctgggggccatcaagaactggggcgcccgggcggacgagttcgactgcttctactttatggccgatatgcataccatcaccgtgcgccagaccccggcggagctccgccgccgcactctggagcaggtggcccagtacatcgcctgcggtctggacccggagcgcaacacaatttttgtccagtcccacgtgcaccagcacgcggagctggcctgggtgctggagtgctacaccatgttcggcgagctgtcccgcatgacccagttcaaggacaaatccgccaagcacgccgacaacatcaacgccggcctgtttacctacccctgcctgatggcggcggacatcctgctctaccagccggactttgtgccggtgggggaggatcagaagcagcacgtggagctgacccgcaacgtggcccagcgcttcaaccacgtgtacggcgacgtgctcaaggtgcccgagccctacatccccaagatgggcgcgcgggtgatgagcctgaaccagccggacaccaagatgagcaaatccatacccgagggctgcgtgttcctgatggataagccggaggacatcctgcgcaagttcaagcgggctatcaccgacagcgacaccgagcgctgcgtccgcttcgaccgggagaacaagccgggcgtgtccaacctgatgagcatttattccgccgtcaccggcaggagcttcgaggccattgaggcggagttcgacggcaagggctatggcgcgttcaagcccgtggtgggcgaggccgtggtggagatgctccggcccatccaggaggagacccgccgcctactctccgacaaggcctatctggagagcgtctaccgcgccggcgcggagaaggcgtcctacgtggcggaaaagactcttcgcaaggtctacaaaaaggtgggcttcctggcccggtaaagataaggagcaaattcccatgccaagaaatctggatcttcccctcatcggcatcgtggccgccgccctggtggtggccctggtggtggccctggtggccactccggtggtaaaaaacctggccattcgggtcaaggcggtggatgtacccaaggacggccgccgcatgcacgaccaccccatcccccgcatgggcggactggccatcttcctgggcttcctgctcagcgtcctgctctttctggacttgaacgcccaaatgcgggggatgctgctgggggcggtcatcatcgtcgtgctgggcatctttgatgatatctactcgctgcgggccatgttcaagtttgtggtgcagatcatcgccgccctggtggcggtgctctcgggcaacgtgatcgagacgctgtccaaccccaacgtgttttccgcggatccctactggaatctggggattctggcggtgcccgccacggtcatctggatcgtggccatcaccaacgccgtcaacctgattgatggcctggacggcctggcctgcggcgtatccaccatcagctccatgaccctgctggtgatcgccctggtagtcagcgagggcaacgtggccattctcatggccgccctggcgggcgggtgtatcggctttctgccctacaacatgaatcccgccaagatcttcatgggggacacgggctccaccttcctgggctatattctggcggtggtgtccattcagggcctgttcaagttctataccattatctcctttgcggtgcccttcctcatgctgggcctgcccatcttcgacacctgctttgccttcatccgccgcattgcccacggacagagccccatgcacgccgaccgcagccacgtgcaccaccggcttatcgacatgggcttcaaccagaagcaggcggtggcggtgctgtatgtcatcagcgccatcctgggcctgtccgccgtagtgctcaccaccagcgggccggtgaaggccatgctgctcctgctggccctgtgcttcgcgggggcgatctccgcccggattttcctgggcgccaacggaaagaaaaacgacggtgagaagccggacgagaagggggaagagaaatgaagcaggtgcgcgtcatgaccatcttcggcacccggccggaggccatcaagatggctcccctggtggcggagctccagcgccgtccgggcctggagccggtctgctgtgtgacggcccagcaccgggagatgctcgattccgtgctggagatcttccagctccggcccgattacgatctgaacatcatggagccccgccagaccctctccaccatcacctccaagtgcctgctgggcatggagggggtgctggagcaggccagacccgacctggtgctggtccacggggacacctccaccaccttcgccggggcgctggccgccttttaccaccagatcagggtgggccatgtggaggcggggctgcgcacgggtgacaagtattctccctttccggaggagatgaaccggaagctggtgggcgatatcgccgacctgcatttctgccccacccgggcgaaccgggcaaacctggagcgggaggggatcaccgacggggtgtttgtcacgggcaataccgtgatcgacgccctcaagaccacggttgtgaaggattatcacttcacaacggatctcctcaaccatttggactacaccggccgaaagatcatcctcgtgacctgccaccggcgggagaactacggccagcccatggctaacatcatgacggctctgcgccgggtggcggacgccttcccggaggtggagctggtctacccggttcacctgtccccggtggtgcgggaggcggcggggaagtacctcggcggccacgaccgtatccacctcattgatccgctctccgccgacgagatgcacaacctgatggcccgggcctatctggtcatgaccgactcgggcggactgcaggaggaggcccccgccctggggcggccggtgcttgtcctgcggcgggagaccgagcggcccgaggcggtggaggcggggaccgtgaagatcgcggggacggaggagaacgtcatcttctccatggcctccgagctgctcaccgctccggcggcctacgccgccatggcccacgccgtcaatccctacggcgacggcttcgcctgccgccggatcgccgacgccattgagtggaaattcggcctgcgggccgaacggccggaggaattccgggcataacgcggtccgggcggagaggagggaacaggcgtggagcgcagaaagcggaatctgctggtggtactcatcggcatcgtcatcgtggtggccatggtgtccagctttggactgggcctctttgcgccggacacggcgaagattgtgctgcccacgccggaggtctcccagcagccggggggagagcccggcgagcagagcggtctggtgctggtggacgtgacgccggagacggtgcagagcgtcatccgggataccctctcccgcccggaccgctacactcgcgcggtcacgatcgaggacttctggggcgagggagagagcggaaccacccatgcggacgtgtgggtggacggcggctggacccagacggaggcagccctgccaggcgggacggtacgttactccatcgtgggagacgggcagttctggctgtggtatggaggcgaccgcacggccctttccggtccggcggacgggcactcggcggatctggagggccagcgcatccccacctatgaggacgtgctggagctggagcaggatgccattgccgccgccggatatgaggagaagggcggcctggcctgcatttatgtggagacaggcgaggacgcgctgggctatgtggagaagtactgggtctccgtggacagcggcctgttggtgtgcgccgagcagtggaaaggggaggagctgacctatcggatgacctcctacgcggtgtcgacggaccgtaccctcttcggactcacggagtttgcgctgccggacggcacagtgctgcatacggtagaggaataacgggcggccggcagggggccggccgcccgttattccagccccagcagcaggagcagccccagggtgatgaccagttccatgtcgtccccctccagaaagaggaacaggaggatgagcaggagcaggacatcgccggtgtcgaggccgtccagcttgaggccccgaagcagcttgcccagtcctgaggcgggcttggcggattccggcgcctcggcgtccggctccggcgggggcgcgtcgggagggacggtctgggtgggaggggcatcctcctccacgacccgggtgtaggaggcgccattgggtatgtagcggttatacatcgtccttcccctcctctcggcggctctggaagagctggaaggccacccggatgacccgggccagcttggcgatctgaacggccttgtcaacctttgcataccgctccggcttgacaaaaggcttgagagcattgagcagggccaccttgcggtcgtcagtggcggagtactcggaaaagaggcgcagaccggcctggagaagctggggatccagctcggacagggcggaaagcgggttgctgtctccgccgccgcccagcatgcccagcagggcggaccagtcggtggcgccggcctgcccggccgcctctcccgcgggcccggcctccgccggttctgcggcggggggcggggcggattctcccgtgtgctccccggtcagcgcctgcgcgagggaagcgatctggcccatggcctggggatcgctgaggatcgcgttgagtttctcctcgaattcggccatgtctcccgccccctcccgccgaaatgcctacttcttctccttgggcaccgcctgactgatgttttgtaccagccgggccccctcgctgctctgcatgacctgccgcaccatgcccagcagggcgccggtgtcccccttggcggcggcggtcttgaggccgtcccccgcgttctgactgagcagctccatcaggcgctgggtgtccggggactgcatcaggctctggagcagggccttgttcttcagcaggccggcggccttgggatccttcatgagttcgtccagattggactggggatttgccataccatcagctccatctcaattatttataagaccgatcactccattctatgagtgacttttcagaaggtgataccttgaagctggtacttttttccgactcccacggcaacgtggccaacatggccgacgtggtgcgcctggagcacccggaccgcgtcctccatatgggggatctggcccgggatgcggaggagctggcccgtcagtttcccgatattcctgtgacctatgtgccgggcaactgtgacggccgccggccggatctgccggacgagcggtgctttaccctggaggggtgtaaaatcctgatgacccacggccacacctaccacgtgaagatggggcccggggcggccatccgcgcggcccgagaggcgggggcgggacttctgtgcttcggccacacgcacgaggccctctgcgagttccagaacggcctgtggatcgtcaaccccggcgccgccgggagcctggttcagcccacctacgccgtggctgtcctggaggagggcggcgcggtgtgctatctgtcgcatatctgagaagggagaggagcagtatgctgctggtcattgatgtaggcaataccaatatggagttcggcgtctaccggggggaggcgctggtggggagtttccgtctgatgacggacgccaaccgaacctccgacgagttggggctctggctgtgccagtacttccagcgcttcggcctggagctggggcaggtggaggatgtggtgatcggctcggtggccccccaggtgatgcataccctgagccgggcggtgcagaagtatgtgggcaagaccccgctggtgctggacgaggcgctggaccccggcctgccctacgtggagtgcgacagcgacgagcgcctgggccccgaccgggcggcggcggacatcgcggccatcgccaaatacggcgcgccgctggtggtgctggacttcggaacggccaccaccctggacgcggtgagccgggagggggtgtacctgggcggctgcatcaccgccggggtgcaggtgtctatcgacggcctgttccagaagaccgccctgctgccccgggtggagctggtgaagccggacacagtgctgagcaccaccgccgtggggcagatccaggctggggcggtgctgggctacatcggggccatcgagtacctcatccgccacgccaaggaggagatcggccagccggacaccaaggtggtggccacgggcggcctgtcccggctggtggcggacaacacagagctgatcgacgtggtggatccccaactggtgctggacggcctgcgcatcatctatgagcgggcgaggagataaaacggatggggaggagaggcaatgagtgagatcaagcggaacgggcacggagccatggacatgactcaggggtcgccgacccggctgatcgtcttgttctccctgcccctgctggcgggaaatgtgctccagcagctctacaacatggtggattcggtggtggtgggcaactatgtgggctcctccgccctcaccgccgtgggcgcgggcttctctatcatgttcctgatatcctccctcttcctcggattctccatgggcgcgaccatcatgatcgcccagtatgtgggcgccggggaccaaggggcggtggggcgcacggtggacaccatctacagcgccctgctggtgatcattgtgcccctgaccctgctgggcgtgctggccagcgggccgctgctcaccctgatccgggtgccgcaggaggcctatgagcaggcgcggacctactgcatggtggtgctgggcggcatcatcggtactctgggctacaacatgaacagcggcatcatgcgcggcctgggggatagccggacgcccctgatcttcctgttcatcgcctgtgtcatcaatattgtgctggatctggtgtttgtgctggtgttctcctggggcgtgttcggcgtggccctggccaccattctggcccagatctgctcctgggtgttcggcatcttctacatcaaccgaaagtaccccttcctccatatccgcctgttccggatgcggctggaccggcgcctgctggggcaggtgatccgtctgggcataccctccgcgatacaggagtgccagttcgcggtgggcatactcatcatgcaggcgctgatcaacggcttcggcaacgattttgcggccggcttcaccgccgccaacaagatcgacaccttcgccttcatgcccatcgagtccttttccatcgccgccaccacctatgtgggacagaacatgggggcggggaggctggaccgggtacagaccgggacccgccgggccctggtgctgggcactctggtatgcctggccatgtcggcggtggtgctgcccctgcggcggcccctgctgatgctcttcaaccgggagcccggcgtggtggccgccggggaggcatacctgctccgggccctctccctgatgttcattctggccatgatgtttatcatgaacggcgtcctccgcggcgcaggcgccacgacagtgcccatggtagcctccatcatctccctctgggcggcccgcatccctgtggcctatgcgctggcctatttcttcggcccggaggagatctattgggcctatcccatcggctgggccctgggcctgctgatctgcgtggtgtcctattgccgtggaaggtggaaggacaagtgcattgtgagctaggcgccgcaggaatagcacagaggccccgccggtctgtccggcggggcctctcctgctggagtcaggactttgtgtagaaatcgcaccaggggcgcagggtacagttggggcagtcgggcttgcgggccatacacaccgcccggccgtggagcaccatccggtggcagaagtcgttggactcctccggcggcagggtgggccggagctgctcctccaccttggccgggtccttggtgccgtcggtgaggcccagtcggccggtaatgcgtatgcagtgggtgtccgccaccactacgccgggggtgtggtacacgtcgcccaaaatcaggttggcggtcttgcggcccacaccgggcagcttgagtagctcctccatggtgtcgggcacccggccgccgtactgctccaccagcatgcgggaggcggctacaatgtcccgggccttggcccggaagaagccggtggaatggatataggtttccacctcggcggggtcggcctgggccagagactccagggtgggaaagcgggcaaagagggcgggagtgaccatgttgacccgctcatcggtacattgggcggccagacgcacggaaaagagcagctcgtagggcttggggtactggagcgaacagagcccttcggggtatagcttcttcagctcctctacgatagccaggacgtcctcatggtttttcatcgaatcacctcttagacaatatagcatagaatccgccaaaaaacgagagccttttttcaaatagggcgattgtaatttaaagtgggattctgtataataaacggtacagtcaaatttgagaaaggtggagtcggatttggtcaaggatatcatggagtttcttgccggacaagaccccgaggtaggggcggcggttcaggcagagtacgaccgccagcggcgcaacatcgagctgatcgcgtcggagaacttcgtcagcccggcggtgctggccgcggcggccacggtgctcaccaacaagtacgcggagggctatcccggcaaacgctattacggcggctgccagtgcgtggacgtggtggaggatatcgcacgcaaacgggcctgccagctctttggggccgaccacgccaatgtgcagccccactgcggcgccaacgccaactatgcggtgtacgccgccctgtgtgagcacggcgacacggtgctcggcatggatctggccaacggaggccacctgacccacggctcaccggtcaacttctcgggaaaaaactataatatcgtggcttatggcgtcaacgaccagggctacatcgactacgaccaggtgcgcgatctggccaaaaagcacaggccccgcatgctcctggccggcgcctccgcctatccccgcaccatcgacttcaagacctttgccgatatcgcccacgaggtgggagcctatctgtttgtggatatggcccatatcgctggcctggtggctgtggggctccacccctccccggtgccttatgccgacgtagtgaccaccactacccacaagaccctccgcggcccccggggcggcatgatcctctgcaaggaggcgctggccaagaaaatcgactccgccattttcccgggcagccagggtggtcccctggagcacatcatcgccgccaaggccgtggccctgggggaggcgatgaagccggagttcaaagcctaccaggagcagattctcaaaaacgccgccgccctggcgaaggccctcatggccgagggcttcgatctggtcagcggcggcaccgacaaccacctgatgctggtggatctccgccctgcctgcctcaccggtaaggagatggagaggcggctggacgaggtgaacatcaccgtcaacaagaacgccatccccaacgatccggagaagcccttcgtcaccagtggtatccgggtgggtacgcccgccgccactacccgcggcttcaaggaggcggacatggaggtcatcgcttctatcatgtggcgcaccgccaccgattttgagggcagacaggacgagctgcgggcccaggtggcccagctcaccggaaaatatcccctgtacgaataagcaaaatggagtacgcatgagcagagacggcggcctgtcgaaaaatggcttcggcaggccgccgtttttctcttgacaaacgcctttaatgtggtatatttataatataaagagcgaaatacaccacataaaaggagtgcatctggatgggtatcaaacgatggtacgggctgatcggcctgctgtccctgttggggtttgtaggggtgttcaccggggagagatatttcctgggcttttttgccttcgcggtggactttcagtatttttttgcccgggctgatgagatgcaggagggccagattctccgctcggccgcacggggctttttcgcgggcatgggagtgacggcagtggggacgctgctgctcctggcccttggcggagggacgacggaggcgctgtacctcagcagcgggctgggctggggggtgggagtggcggtatacgccctctccagcttcctgtgcggctgccgggaatggtggaacgcgcgggcatgattaccaatcgcatcaaggagtaccgggcccgcttcgacctgaagcaggaggagctggccaggcgggtgggagtacgccgggagaccatcggcaacctggagaaggggcgctataatccctcgctggtgctggcctggaacattgccaaggtattcggcgtaccgattgaggagatctttaccgtggagggggatgaatagtatccgccgctctttacgggggctcgaacatgtgttagaataggggcgaccaaacgaggagggatgcccaatgtcataccggcccctggccgacgagatccgcccccagagcctggacgaggtggtggggcagcgccatattttgggggagaacggcctgctgcgccgcatcatcgagagcggacacatccccaacctggtcttttatggcccctccggtaccggcaaaaccacggtggccaacatcatcgccaggcgcaccaaccggcccctccaccggctcaacgccaccacggcctccatctcggatatcaaggacatcatcaaggacatcggcaccatgctggcccccgatggggtgctgctctatctggacgagattcagtacttcaacaagaagcagcagcagtctttgctggagtttatggagaacggcaagatcaccctgatcgcctccaccacggagaacccctatttttacgtgtataatgcggtgctcagccggtctaccgtgtttgaattcaagcccatcgaggccgtcgacgtgctgcccgccatcgaccggggcatccggctcatgggggagcgcctaggtgcggaggtggactgcgaggatggcgtgcgggagcacattgccaccgcctgcgggggcgatgtgcgcaagtccatgaacgcggtggagctgctgctcagctccgcccggcgggagggggagcggctggtggtcaccctggccgatgcccagacggtggcgcagcgctccgccatgcggtacgaccgggagggagacgatcactacgacatcgcctctgccctcatgaagtccatgcggggctccgaccccgacgcggccctccactatctggcccgcctgctggaggcgggggacatgaccaccgccatccggcggattctctgctccgccagcgaggacgtgggcatggcctacccccaggcggccctgatcgtcaaggcctgcgtggacaacgctctccagctcgggctgccggaggcccgcctccctctggcccaggcggtggtactgctggccaccgcccccaagtccaactcggtctacgaggccatcgccgccgctcaggccgatgtgcgggcgggcaagaccggcgactacccccgccacctccagaacgtccacgccgactcggcggggatggagcgggagcagggctacctctacccccacgactttccgcgccactgggtgcgccagcagtatctgcccgacctgctggcggataggtgttactaccactacggcgacaacaagaatgagcaggccgccaggcggtactgggacgagatcaaaggccccgaggcataaaacaggagcgcggcatagccgcgctcctgtttttcaggcgaatatggtctccgcgcccaccttgacacagccctcgggggcgtatttccacttttcaatttgtccctgggtgagaaaatactccagcggcgcggggacgttcagcgggggcagggtgtcgatggccagcagcttgatcttcatccgctcaggcaggatagccttgatgtagacggacacacggtccccctcccgcaggccgtttttccgctccgccaggccggacagattcggggtgagctccacaaaggccccatactccttgagcccgcggacgataccgggcaccgtcatgcccgcctgaaagcgggcggcgttctccgcccaggtgcccagcagctcccggtgggtcaggtacacccgccccagcttggggtccagctcctgtaccacggcgaagatggcctgccccacccggaaccgctggtcggggtgggggatgcgggagacggagatgttttcaatcccgatcagggagggaacgccgcagccgatgtccacaaaggccccgaaggactccaggtgggtgaccacagccgggaggatacagccgggatgcagcccggcaagcatggcgtccagggcggcctgctgggcccggcggcgggagaggcggggccggaggacgccctcagattcctccagagctgtgatctgaaaacagaccggcttgcccacccgggagagaatggcgatctcccgggtggtgccctctgcaatgcccagcgcggcctcctcccgggggagaaagccggtaaacggccctacggacaccagcaggttgtgggccccgtcgcagagctgggcaaccccctccagcaccgtctcctcctccatggcccggcggaggccgtcgcgggaggcgcaggcggcctcgttttccggtgtatgtaacagacgcccctcgggcaggaagcggctcctcaatgtgaccaaatcctttcgtttccacagtcatttttttccgatagactactatatgcacttgccgggcctgaattgacagggtataataggcgttacgaaggaaacgggagggacgcggatatggacatccatgtgggcgatgtgctggaattgaagaaggagcacccctgcggcagccggcggtggctggtgctgcgggtgggaatggacttcaagctgcgctgcgagggctgcggccacgagctgatgctcccccggagcaaggcagagaagagcatcaagcgggtgctgcggacggaggagccccaggcatgaggtacgaggggacggtttaccgcccgccgggagagtggaagagctatctgctccaggtgacggtggggtgctcccacaacgcctgcaccttctgcggcatgtataaggacaaacgctaccgggtgcgcccgctggaggagatttttgaggatattgccctggccagggcggcctatggagacgtgaagcgggtgttcctctgcgacggggacgcggtggccatggacacagaggagctactggccgtcctggaccggctgtacgagaccttcccctccctcgagcgggtcaacgcctatgccggcccgggcagcaccctgcgcaagacggaggaagagctggcggccctccgccgggcggggctggtgcgtctctacctgggggtggagagcggcagcgacgcggtgctgcgggcggtgcgcaagggggtggacgccgcgggtatgctggaggccggacggcgcataacggcggcaggctttgacctgtgggccatggtgctgatcggcctggccgggcagggagaggcatcccgagcccacgccctggacacggcggccctgatcaacgccatgagaccccgtcacttctccgccctgacttacctccccgagcggggaacggtgctgggtgacgcggccgcgcggggggagttccggctgctcaccgcccggcaggccctggaggagacccggctgctgctggaacgcctggaggtggagccccttcatttcaccagcgaccacgcctccaactatctgcccttgaagggcggactgcccgaggacaaggcccggcttttgtctctactggacggggcgctgtccggcgggcaggccgtccggccggagctgtggcgggggctgtgacacaaagagaggagtattgagatggacggacaacacctgcatattctgtggaccaacgccgatccggtggtctttgacaagatggttctgatgtacgcggtgaacagcctggtacggggctggtgggagaaggtgacggtgatcctctggggggagaccgcccgtctggcggccgcagatcctgcggtgagggagcgcattgtcctggccatggagcagggggtgaaattctcggcctgtattacctgcgccaaggagcttggggtggagcaggcgctgcgggacatgggcctggaggtcatctcctggggcccgccgctgaccgagctgctcaagacccgggcgcccctgctgaccgtgtgacggaaacgaaaaagaagctgacgcgctgcgcgcgtcagccagacggtcaataagccctcctgcgaaaggattcggagggagggatagtgtgaaagggaaccgtcagagttccctttcgcgttggatcaaacaactttttgaagcttttctaaagcttcaaaaagttcgacaggctggctgacgcgcgcagcgcgtcagcttctttttttgcccgtcccggatttgaccttttttgtggacgtggccctctataatgggaaacgacaggccagaggacagggggggacgcggggtgacggtgatctatctggatgagctgttcctgctcaactttgtggtggactatctcctgctgctggccgccggacgcctgtccggcgagatactccgccggggctggctggctctgggggcggccatcggggcggcctacgccgccgccgccgtcctgccgggcatgggctttctcctccatcccctctgcaagctgggggcggcggtgctggccctgctggcgggctacggcaaaagccgccgcctcctgcgggtgagtctggtattctttgccgtgtccgcagctttcgggggcggcgtgttcgccctccagctcctgggcgggcgggggctcactctgcaaaacggcatcttttattccgccatggatctgcgccttatcctcctgtcggcggcggggtgctatgtgctcatcaccctgctgttccaacgcaccgcccggcacagcggcctgcgccgggagctggtgcctgcggtactcaccctggaggggcggcgggtggcccttaccgccctggtggatacgggcaacaccctcacagaccccgccaccggacgtccggtgatggtggcggagggggagaaggtgggggctctctttcccgacgggcaggcgccggctcccgaggagctgcgccgcccggtggagaccctggagcggctgggccgccagggctggcaggggcggtgccgcctgctgccctaccaggcggtgggggtggagtgcggcatgctgctggccctgcgcctggacggggcgcgggtggggacggaggactacggcaagctgctgctggccctgtcccccacccgcctcaccgacgggggcggctatcacgcgctgattggtacataaacagacgatgtgggaggatggctatgaacggttggagactgcgcctgtttgtgggcgtggagcggctgttggcccggctggggctcaagctgccggggaagatcatgtatatcggggggagcgacaccctgccgccgcctctgtccagggacgaggaggcggagctgatcgcccgtctggacggtggggacgagggtgtgaagtcccagctcattgagcggaacctgcggctggtggtctacatcgcccgccgctttgaaaataccggcgtgggcattgaggatctgatttccatcggcaccatcggcctcatcaaggccatcaatacctatcagcccgcaaaaaacatcaagctggccacctacgcctcccggtgcattgagaacgaaatactgatgcatctgcgcaagacggccaacctgaagagcgaggtctccttcgacgagcccctgaacaccgactgggacggcaacgagctgctcctctccgacatcctggggacggagagcgatctggtgatgaagcccatcgaggcggacgtggaccgccagctcctctccgacgcgctggagaagctggaggaccgggagcgggagatcatcaccctgcgcttcggcctggacggccgcccggagcgcacccagaaggaggtagccgaccggctgggtatctcccagtcctacatctcgcgcctggaaaagcgcatcatcagccggctcaagcgggagattctgcggatgctgtaggggcggtcactccgccttcgaccgcccggctcgccgggcggccggcttcgtcagatcgtagctgagctccagcaggcggatgatctcctcctccgggagcgagccgtctaggaggagggtgacccagttggacttgttcatgtggtaggcgggcaggatgcctgggacgccgagaagggagccggccaggagcgggccgcattttacatcgagaatgtcgacggactccggccgttccagccccagcctggttccgggaaactccagaaagaccgcaaaccacttggcgttttcactgtggcgcaggacggcatagcgggggaatttagcccagaggtgctccggttccgcgcccagatgtacctgggcatactgtaggatacgctctttcagtgtggacggttggttcatggcactccctccttacagatccttggccctcattttctccagctcggccttttctgccgctgtggccttgttccgcccgatcagccaggcggcggccagtcccgcggcgcagggaatgcctggaagcatgccggagggatcccgaatcgcgatggacaggccggccagcagcaggaggatcccgccgggcagcagagcccccagcaggggctttctccgggtacccagatagtattccagagccaaaagggccagggaaatgaaaagaactgcaagctctctcatatatgttttctctccttctcgtatttgtcgatgatctgcttggcggtctccacatcaatgcgggagtccaccgccagccccttgataaaggcggtgaagggctcctcctcctgttggtcggccagctcgatcttctggatgagcttgtccagccgcagacggaccgtggggtaagagacctggtagagccgggcgatctccttcagagagccggacttgagcgcaaaatttttgagaaaggcggagtcctccggttcgagagcgagcatccactgggggattttattaagctccaatttaattctccttttatttttggtttaattatattgaatataacataaataaaatgaaagtcaagtataaaaaagaggtgcggctttttagccgcacctctttttgagcttacaggcccagggtgtccgccaagtcgtccttcatgtggtccatcttgcggacggcacgccgggccatccggcgcacgtcggggctctgcatgctcttggcggtcaccgccataccgatggcggcgcccgccagcacgccaaggcccatcccttccagaaacgcatgcttcgtcatattgcttcgctcccttctgcatcagcgtccgctgttattattgccggaaacgcagaaaaatccgttgctaaaaactgtgtttcaaggtataatgtatgcggtatgatacggttcaatttgtggaggggacgggggtggacctgtacccttttttgctgtgctctgcatggcggtttggaacggtttcaatgtgaaaggagtgatttcgtgaagctgctgatacggcagggacggctggttgacccggttgggggcatcggcgggattatggatgtgctggttgaggacggaaaggtagcggtcatcgggagcaacatcaacgagcccgacgcccgggtgatcgatgcccggggactgaccgtgtgcgccgggctggtggatatgcatgtacatctgcgggagcccggctttgaatataaagagaccatcgagaccggcgcggcggccgcggcccatgggggctttacctccattgcctgtatgcccaacacccgcccggccaccgacagcccggagcagattgcatttgtaaagcagagggcggcggaggcctgcggcgtccatgtctggcccatcggggcggtgacccggggacagcaggggcaggagctcaccgactttgaggccctgaagggcgcgggggcggtggccctgtccgacgatggggtgccggtccagaatgccaatttaatgcgggacggcctgatcctggcccaccggcaaaacctgacgattctctcccactgtgaggacgccgacatggtgaagaactacgcggtcaacgaggggcgtatctcccgccagctccggctggctggccggccggccatcgccgaggagctgatggtggcccgggatgccatgctggcggaggagaccggcggggcggtgcacatctgccacatctccaccgccaaatcggtggccctggtgcggcggtacaagcgcaagggcgtacagatcacctgtgagacctgccctcagtatttcagtctcaccgaggacgagattttagcccagggcgccctggcacgggtaaacccgcccctgcgcaccaaggcggacgtggaggccattatcgagggattgaaggacggcaccattgacgccatcgccaccgaccacgccccccactccgctgaggaaaaggcccggcccctgaccgacgcccccagcggcatggtgggcctggagaccgcccttgctgtggcgctgacctacctctaccacacgggcgagatggccctgtccgacatcctgcgccggatgaccattaacccggcctgcatcctgcgcctgcccaccaaggggcggctggccatcggctcggacggcgacgtggtgatcttcgatcccgacgaggcgtggacggtggatcccaaccgcttcgcctccaaggggcgcaacactccctttgcgggaaagaccctgcgggggaaagtgaaatatacgattgtaggcggcgagatcgtctactgggaaggagaatgagcgcgatgtcctttgatgtattgcaggagaaaattatccgtatgaaaaaccccacagtggtggggctggaccccaagcccgagtatgtgccggagcacatccgcaaagcgtcctatgaacagttcggcgagaccctggagggggccgccgacgccattttccagttcaacaagggcctcatcgacgccctgtgcgatgttgtacccgccgtcaagccacagtccgcctattatgagcgcctgggctggcacggtatggccgcgctggaaaagaccatccgctacgcccacgagaagggcatgtacgtcatcgccgacatcaagcggggggacatcggctccacggcggaggcctacgccgacgcctggctgggagtcaccaaggtgggggaggccttctgcgggggcttcaacgccgactgcgtcaccctcaacggctacatgggcgcggacagcgtcaaccccttcctaaaggtggcgggggagcgggacaagagcgtgtttatcctggccaagacctccaaccccggctccggcgagctccagaacgtggccgccggggagggagacaccgtctacggccttatggccgacctcattgagaagtggggagccggcactgaagggaagtacggctatatccgggccggcgcggtggccggggctacttatccagaggagctacagaagctccgcgcccggatgccccacaccttcctgctggtgcccggctacggggcccagggcggcaccgccgaggatgtacagtatgccttccaggagaatggctggggtgccgtcgtcaactcctcccggggcatcatctgtgcctggcagaagacgggcaaaaacggcgcggactaccaagaggccgcccgcgccgccgccatcgccatgcgggacgatatctgccggtttatcgccatccagtaaaccaaggaaacagagggggacacacccatgccaatacaaaagctctgtaccgtcgcagaggcggtgcgcctcaatgaatttgcctggtccctcaccctggaggccgaggggatggagccccaggggccggatcagtttgtccatgtgaagtgcggccacagccgtctgctccgccgccccatctccatctgcggctggggggagaaccggctgcgcatcgtctttgaggtgcgcggggagggcaccgagtggctcgcccgccggaaagcgggggacaccctggacgtactgggccccctgggctgcggcttccaagtggagcgagaggcccgctgcctcctggtggggggcggcatcggcgtcccccccatgctgggctgcgccaagtggacggcggggcagagcaccgccgtactgggcttccggtcggcagaccgtgccatgctgaccgaggaatttcagaaatgctgtaaagatgttttgctttgcagtgatgatggaagcctaggacagaaaggctttgtggatgctcaagtgcgggctgttcttgaaaaggataaaaactttacagcggttttggcctgcggccccaagcccatgctgaaaaacgtggctgtcgtggcggcggagtacggcgtgccctgccaggtgtccatggaggagcggatggcctgcggcgtgggggcctgcctgggctgcgccatccagatggccgacggcaccatgaagcacgtgtgcaaggacggcccggtgtttgacgcggaggaggtggcgtggaatgtctaaggtggagcagtccgtggtgctggccggggtgcggatgaaaaaccccgtggtggtggcctccggcacgttcggtttcggccgggagtacggccggttttatgatttgagcgagctgggcggcatctgctgcaagggcctgaccctctgccgccgggagggcaacccgcctccccgcatcgcggagacccccatgggcatcctcaactccgtgggcctccagaatcccggagtggacgcctttatcgcggaagagctgcccgagctgagaaagcatgatctggcggtaatcgccaacatttcgggcaataccccggaggaatacggcgtcatgtgcgaaaagctctccgccgctggggtggacatgatcgaggtcaacatctcctgccccaacgtgaaagcgggcggcctggcctatggcaccaagccggagctggccgccgaggtgacggcggtggccaaggcccacgccgggagagtgccggtgatggtgaagctctcccccaacgtcaccgacatcactgagatcgcccgggccgtggcggacgcgggggcggatgccctgtccctcatcaacaccctgcgggggatgcgcatcgacgtgcgtacccgccggcctattttgaagatgaacaccggcggcctgtccggacccgccgtgctcccggtggcggtgcgcatggtgtgggaggtggcccaggccgtgaagctgcccatcctgggcatgggcggcgtagccaagggggaggacgcggcccagctcctgttggccggggcctccgccgtggcggtgggcaccgcctgctttgacgatccctatgcccccatcaaggtgcgggacggcctggcgtccctggcggagcgccaggggctgaacaaggtatccgactttaccggggcggtcgtgccgtggtgaatggaggtgcgcgccgatggagcggaacacctgttatctgaacctgtccgtggcggaggcggcccgcaccgtgtccgagctggtggaacgtgcggggctgtccagccggatggtggattgccatgagctgcgccagggcgagaatctctgtggcatggtgctgctttttgaaaagtactttctccgcatgggcagccgcctcaccctgacggcggtgctggacaacctggaggggcgcacccggctctactggacggtcaccggcggggcgggaatgctccggcagagcggagacagcaagacagcggcggaggagtacagcgaggccctgcgggagaagctgttctcctatctggacggctgaaggcgggagggaaaaagatggaggattcgtattctgtctccctgggactgcgggagtgcggggaagccatccatgcggcggtgaccgacagcgtcaccggggagctggttgaccactatgagctcacccacccgggcggcggcacctgtgtggtggcggtctatgagaagcactactaccgggcgggcaaccggctcaccctcaccgtggttctggacgactttaccggccgaacccgcgtccactgtatcagcggcggcgggggcgaggggctgttccgcttcgactggggggcggcggagtccttcgagggagtcgtccacgacgcgttgagccactatcggctctgaggaaaaggatatggcttatacagaagtgttctaccccaagctgcccatggagggctgtgcggaccgcattcaggatgtgatcgtgcgcagcgggttcagcaatggacaggtgtcggagcgctaccggctggagacccccggcggctcggttctggttctggtgttggtcaagtatcttcacagaaccggaagcgagatggtggtgacggcagtgctggacgagctggaggggcggctccgtctccatctcactgctgccagtgcgctgggcggcatgggagatgagtgcggcgaggagaagcatattgtctccaagctggaaaagactctggaggtatgagaacaatggatttcagattcagaggtggagtaaagcgatgacaaccgtctatatggtccgccacgcggaggcggagggaaatctctaccgccgggttcacggctggtacaacagcctgattaccgataacggctaccggcagatcgcggccctgcggggacggtttgcggacatacatatcgacgcggtgtactccagcgacctgttccgtacaatgaccaccgccaaagcggtctacctgtcccacggtctggagctgcacaccgatccgggcctgcgggagatcagcctgggcgcatgggaggacaagccctggggcgagctggagcggtgcgacgccatgaatctgatccgctttaaccacagctccccggacttccgggtggaggggggcgagaccttcgcccaggtacaggcgcggctcaagggggcggtgctccgcctggcggcggcccacccgggccagacgatcgccctgttctcccacggcaccgccatccgctgcctccagggggccctccgggggctggggcccggcgagatggacggcttgggccacagcgacaacaccgccgtcacctgcctggaggtggagggggagcgcacccgcaccgtctttgagaacgataactcccacctgcccgacgagatctccaccctggcccgccagcggtggtggaaggggcgggatggaacaagcggcgatgcaaacctgtggttccggcccctcaacctgaaaaaggaggggacggtgtaccggacggcccggcatgaggcctggcaggatgtgaacggcccggcggtgcccttcgacggggacgcgttccagagggacgccctgcgctgctggaaacgggccccggagcgggcggtgatgtgcgccatgcagcgggacgagacggccggcctgctccagatggatctggaccggggggccgccgagggtgtgggctatatccccttcctgtacatggaccccgcccatcggcgccagggcctgggggtgcagctcctgggccaggcggtatccacctaccggcctctgggcagagaccgcctgcggctgtgctgcgcgccggacaacgggattgcccagcgcttctaccagaagtacggctttgtcaagatgggagaggagccgggtgcccgcggcccgctggatgttctggaaaaatacattggatttgaagccaaggaatcatgaggaacctatgaatcaatttttgcctgtcaccaaagcggatctggcggagcggggctgggaggagtttgacttcctggtcatcaccggcgacgcctatgtcgaccacccctcctttggcccggccattatttcccgggtgctggaggccgagggctaccgggtggcaatcctggcccagccggactggcgcaaggctggctcctttacagcactgggccgcccgcggctgggtgttctgctctccagcggcaacatcgactccatggtggcccactataccgtggccaaaaagcgccgccatgacgacgcctattccccgggcaatcgggccggcctgcggcccgaccgggcggtgatcgtctatgccaacaaggtgcgggaggcctttggggacattccgctggtgatcggcggcctggaggccagtctgcgccgctttgcccactacgactattgggaggacaaggtgcgccgcgccatcctcttcgacagccaggcggatctgctggtctacggcatgggagagcgcgccacccgggaaattgcggcccgtctggcctccggaacgcccatccgggagattacagatgtaaagggaaccacctttattgccaaagatccttctgcgtgtgcctatccaaaggtggagtgcccttcctttgaggcggtatccacggataagcgggcgtatgcccaggccaaccagatccagtatgaggagcacgaccccgtccggggaaaggccatcctccagcgccacggcgaccggctgctggtggtcaatccgccggccatgcctctcaccactgccgaactggacttcgtggccgagctgccctacgtccgggaaccccaccccatgtatgacgagatggggggcgtgcctgccatcgaggaggtgcgcttctccgtggcccacaaccggggctgcttcggggcgtgcaacttctgctccctggccttccaccaggggcggatcatcacctcccgcagccatgagagcgtcctgcgggaggtggaggccctgacccgccaccccggcttcaagggctacatccacgacgtgggcggccccactgccaacttccgccgccccgcctgcaagaagcagatgaaggcgggaatgtgccggggccgggcctgcctggcccccacgccttgtcccaatctggacgccgaccacaccgactatttgatgctcctgcgcaagatccggcaggtgccgggggtgaagaaggtgttcatccgctccggcatccgcttcgactatatgctccaggacaagagcggcgagttctttgccgagctggtgaagtatcatgtctccggccagctcaaggtggccccggagcactgtgtgagcggcgtactggactacatgggcaagccccatatcgaggtctatgagaagttcaagggtaagtacgagcggctgaaccagaagtacggcaaggagcaatacctggtgccctacctcatgtcctcccacccgggctgtaccctggacgacgcggtgcggctggcggagtggatcaaccgcaccggccgccagccggagcaggtgcaggacttctaccccacgccgggaaccctgtccacctgcatgtactacaccggcattgatccccgcaccatgcagccggtgtatgtgccccgtgatccccacgagaaggcgatgcagcgggcgctgatgcagtggaagcgcccggagaagcgcccgctggtgcgggaggccctccaccgcacccaccgggaggatctgatcggctacggcaagggctgtctcctgcggcccaacggccccgccaggccgggggatcagccctccggccggggcaagcccgcgcccgccaagggcaaggcccagcccacccgctcccgccccgccaaaaaggtgggctgggccgtggctaagcccaaaaagaacgcccggccgaagaaaaagaaataagaaacgagcctcagacgcttgtgtctgaggctcgttttttagggaagcaccacccgttccagccgggggccgaggcgggagagcagctcgttggtgatggtacccgccgcctgggcggcctcctcggcggtaaggacggcgtccccgtcccggccaatgagagtggcggtatcgccgggggcgacgccttccatatccgtcacgtccaccagaagttgatccatacagataagtcccactatgggggccgttcggccgtggaggagcacccggcccgccccgttggagagggtacggggccagccgtcggcgtagccgatggacagggtggccagcacagtgggccgatgggcggtgtaggccccgtcgtagcccgccgcctctccggcggccagggtgtgaagctgggataccctggcccgcagggagagcaccgggcggagggggaggaccgccgtggtggcgtcgccgggggcgctgaggacgccgtacagggcgatgccggggcgggcgcagccgcaggggaggccggggtagttgagcaggccgtagctgccctggaagtggacggttccgggggcgtgtccggcggagcgcaggccatccaccgctgcccgaaagcgccggagttgctcccgggtacgggcttggctggcctcgtccagccgctccgtgtcggccaggtgggtgaatacgccggtcacccgcagatgggaacagctgtaaggggcggtcaggctctgggtgtcgtcccaggggatgcccagacggtggaggccggtgtccaccttgaggtggacggccagccgccggccgcatgcgtccagcgcccgggcgtgttcggtgctcaccaccgtctgggtcaggcggtaccgggccagcaggggggccagctccggcccggaatagccaagcaccaggatcgtcccccggacgccgccccgccgcaggcggacaccctcggcggcggtggccacggcaaaggcgtccgcgcccgccccgacgcacagccgggcgatctccaagtccccgtgcccgtaggcgttggccttgattaccggcataaggctggcccccgccggcagaagggagcccagggcggccagattgtgccgcagggcggcggcgtccagctcgatccaggcccggctccggggggagggggcggggcggatgcgggcgaaggggagggccagaagggaggagagcaggaccacggccagatagtgtacaagacagttgtccaccagcaggccggtgaggcccaccaccccggcgccgccccggatgaggacgatgcaccaggggtggaggacatacaccgccgccgcccagtcccggagggcgggagcggacgggagggacaggcgctggagccaccgcaggaggaacccgacgcacagggggagggagaggtagagggcgtcaaagcgggccagggcgaggcgctgcaccagcaggccttccgccgtcagcagcgccagggagaggagcagtccggccccgtaccaagccgcgctccggcgggcaggcctcagggccagccagccccccagcagcagaaagacaggggggaagaacaggccgttgcgtgtgtagtcgaagaggaggaacagggcctcgtacccggcccggaggggcggcagggcggcggtgaggccgaaatagctgtcccccagcagcccggcggcatagagcagaagggcgggaagccacgcccagcggggccccaggatgcgcagaaggccgtacaccaggcaggcccccagcaccagggcggggaagtaccacaggtggtaaaaggtgccgttgaagagcacatctcgcagcagggcgaagccgctctcctccagggtgtggttgtagaggttcagggggaggtagagcaggaccgcggccccgtaaagcagcagcagctttttgacaaaggggatcagggcggcccgcccctcccggagcagacggggcaccaggaaccagccggacaccgagaagaaaaaggggacggcgatgcgggccagaatgtcggtcaaaaggtagttggcctccccgttcagggacagaagagggccggtatggatggcgatgaccagcagggcggcggggacgcggaagcggtcaaagccgccgagcgactcggttttcatcccgcatccctccacagggtgagcaccacgccgccctcgttggtgtcacagcgctggcaggggacgtcggcgggcagggtcagggtgtccgccgcccaggcgggcaggtagtaaagctcaaacagacgccccagcccccggaaacgaagaggctcccctcccagcgggaagtcgtgaagccactccagatattcctccagtaccagatgacgctcctccatcagcttggcgtggggccagcccacgtaccggaagtgccacggctcgtatccgatgccggtgacagcctccttccccttggggtagcgaaggataaagccgaagtcggcggcccggcggcgcagggccccgcaggggccggagtcggggaaggcggggcagaggaagtccacctccggcccgttctcgcccagatcaatggccagcccggtctggtgctcgctgcaccccggacgggccacataggtctcggtgaaggcactgccgtgctcggccagggtgtcgtcccagatggcctgctgctcggtttgagggcggtagccgctgaccggaatgatggtgcccgcgccgtccactgcggcgagaagctgatccaacatcactttggctcgctggtggagacgtacctcggtttgaccggagcggacggaggcgaggtcctccgcggcgggctcctccggcaggggatgggcgcggttgaccagatacagcgtacccttcatgcgtccaccgccagtccgatgagacggtccagcagagggccgaactccaggcctatgctccgcatcatgttggggtagcggctgtgagctgtgaaaccggggatggtgtttacctcgttaaagacaatgcgcccgtccggcgtgagaaacaaatccacccgtgcaaagccggaacactccagcgcccggtagatcaactgggcggtcgcctgaatttctgtttccttctcctgggaaattcgggcgggcatgtgtatgctggaggtgatcaggccgtacttctccgtgtagttgaaaaagccgccggagagctcgatctcgtccacatgtcccaccgtcagaacctcattgcccagtacggcgcagcccacctcaaagccgggcacggcctcctcaatgaccaccttgctatcgtgggccagggcggcggtgacggcttcggccaacacgccgggctcctccaccttggtgatgccaaaagaggaacccgcccgtgcgggcttgacaaacaggggataggtcaggctggcagtgcgctccggcagggtgtccagcccttctccggtgcgaaagagggcggaagggggcactgctacaccggcggcccggaccaggcggtgggccgcgtccttgtccatgcacagggcggaggcgagcaccccgcagcccactacggggatacctgccagctccagcaggccctgcaccgtgccgtcctccccgtttttgccatggagtaccggaaaggcggcgtccagatagcgggtagagggcccagcgggggcgatgagcagcaggccgtggacgccgcggtcgggggagatcaccgccgggacggtatggcgggcgtcggtgtgccaagtgtcgtccagcagggcgtccaccggcccctggtagagcagccagcgcccatcccgtgtgatgcccaggaggacgggctcgtacctgtcccggtccagatgtgtgagtaccgcgtgggcggactggagggagatctcatattcggtggaagagccgccgaacaggacggccaatgtgatttttttcatgggggaacacctccgtcagaatgggctctcgcctgttcttttattatagagggagtatatcaggcgtttctgacttccaaccgaccaaaggcttacaatcctctgaaccaaatcttaaaaaaagcagtcaaaaagcggtatggtctcagaccataccgctttttgtcattttgtggctcgctttacaccgttgccgatgtctttggcggcgtcgccaacgccgtcgacgatgtcgcgggctgcatcgcccacgccgcgggttacgtccttggcggcatccccggcatcccggaccgcgtcacgggcggccgagccgccgtccttcgggtgttcggtaccctccggggcgggcgtggtggtattgggggctgcgggggtgttctccggcatggtgctgggctgggaggtgacaaccggcgagggagtcggagtcacatcaggggctttatcgcgggtacaagcggtcagcggcagagccagagcgagcccgatgccgagcagagtccatgtgcgtttcatatgtgttcctcctgttccttccaatggatttcgttcagatggattcacccagcacctagtatacgttattccacgctgattacacgcgggaagaagtgtcagagaaaaagggttgcaatttccagaaagatctgctaatataataataacagtaatagttactgtttataatgtgccgagaaaagaggtggctcatgaacggcaagcgctattcccggcagcgggaattgatctatgaggctttgcggcagacagaacagcaccccacggcggagatgatttatcagtggctgaagccggccaatcccagcctgagcctgggaaccgtttaccggaatctaaaccttttggcagatgaaggtgcaatccgccggatggcatttccggtggagcgctatgacgcaaagacaatgccccaccctcatttctgctgtgaccagtgcggggcggtttacgacctgcaccttccctacgatgcggagctggaccggcaggcactgctggccagcgggcacgatgtcacgggccatgaggtggtttttcacggaatttgcacaaagtgcaaacaacttcattgatcttttcttaaaatatgataagatgtgaccatcaaaattagaaaggaaggttgttccaatggaattcaagctgtatcgctgtgcccactgcggcaatgtcattttcaaggtggtcgacaagggtgttcctgtcatgtgctgcggccagaaaatggaggagttcgtccccaacaccaccgatggtgctatggagaagcatgtccccgcagtggaaaagactgcccatggcagcggctattccgtcagcgtgaaggtgggcagtgtggagcaccccatgctccccgagcactacatctccatgatcgcggcggtggatggggacaccgtcaccatgaagttccccaagcccggcgaaaagcctgagctgaagaccttctgccgcagtgagaaagtggaggcgtacgaaatctgcaatctccacggcttctggaagggcgagggctgagaaggcccgtatttcactcaaaatctgatttagaaaggaaggctgagcattatggagctgaagggaagcaagacggaggccaatctgtggaaggcgtttgcgggagagagcatggcccgcaataagtatacttattttgccagcaaggccaagaaagagggcttcgagcagatcgcggccatctttgaggagaccgccggcaatgagaaggagcatgccaagctgtggttcaaggagctgggcggcatcggcgataccgctgccaacctgaaggctgcggcggcgggtgagaacgaagagtggacccagatgtataaggagatggccgaaaccgcccgcgaggagggctttgagaagctggctttcctgtttgacggcgtcggcaagatcgagaaggagcatgaggagcgctacctgacccttttgaagaacctggaggagggtgtggtctttaagcgcggtgacgagtatgtctggaagtgccgcaactgcggccacatccacttcggcaaaaccgctcctgaggtctgccccatctgtgcccatccccaggcctatttcgagatccgcagcatcaattactaagaagagacgtacgacaagcgctgtataaagcgggtccgacctgacggtcgggcccgctttggccgtctaaaaccttattttaacagatagactgccccgccggagacccggcggggcagtgtgcttttactttagcaggcggatccactcgctgttgtagagctcacggatttcaggggagagacaggcaaagctctccgtcttggcatatacgtcgtcggtagggtaggcatagggatcgttggcggtctcagggtccagctcctcacggacactcagcagaggggaggagtaccagatctcctcacagttcttgaggccggcctgagtggagcacatgaagttaatgaacttctcggcgttctccttgttctccgcgcccttggggatgcacatggcatccacgtagagattggtgccctcccgtggcagggcaaaggccaggtcagggttgttctcctgcatggtaagaaaatcgccgtaatagtaggcgccgatgagggcgttttcaccctccagcttgtcgaaaatctcgtccatgacgtaggactgcaccaggggcttctgctctaccagaaggttggtggcctccttgacctgggcgggatcctcagtgttataggagtagcccagcttcttgagggcaatgccaatggcgtcgcgggagttgttgaacatcagaatgtcgccggagagctcctcatcccacagaatgtcccaggtttccacatccttctccgcagggtcaatgtaggcgctgttatagatcacgcccagcaggccccacatgtaggggacggagtagaggttctccgggtcgtactccgggtttttcagattggggtcgatgtcggcaaagttgggaatattgtcaaagttcagcggctccagcatgtcctcctcgatgagctgaccgatcatatagtctgaggggatgatgacgtcgtagccgccggcgccgccggccagcttgccgtagagcgcctcattggactcaaatgtctgataattgaccttgataccagtctccgcctcgaaatcctccagaacggacatatcaatgtactcgccccagttgtagacgttgaccacgccggcagtgccggtgttgccgctggaactctcgccgcccggtgtctcggctgtgccggaaggcgatccgccggtacagccgctcagggccgccgtgctgagggttgccagtgccagtacaagtgcaatttgctttttcaattcctttcgtttgcccctttcaaaaaataatattatatcaaggcgggctgcctttgatatccgtcagttcccatgaaccatgcggcgcttgtcctgccgggtctggcgtacattgacgatgaccagtagggtgaccaccaccacgaagagcagggtggacagggcgttgatctccgggctgacccgcttcttggccatggaatagatgaccatggacagggtggagaaggtggagccggcggtgaagtagctgatcacgaaatcgtcgatggacatagtgaaggcgatgagcaggccgttgatcacgccgggcatgatctcaggcaggatcacctttcggaaagccagaaagccgggagcgcccagatcctgggccgcctcatagatattggggtcaagctgctggagcttgggcatgacgcagaggatgacgtggggaatgtcgaaggtcaggtgggcgatgagcagggtgacaaagcccaggttccacttgatgcccaaggcagctcccagtgtgccgttaaagacgttgaccgccagtacaaagaacagcatcatggacacgccggtgatgatgtccgcgttggtcagggggatgttgttgatggtggtgaccaccgtgcggctgcggcggcggaagttggtgaagccgatggcggctgccgtgccaatgatggtggagatcactgcagccagaatggaaaccgccagtgtgacccacagggcgtccaggatcatggagttctggaacaactccttgtaccaatccagggtgaagccggaccacaccgaccggctcttggacgcgttgaaggagaacacgatgagcacgaagatgggcaggtagaggaacaaaaagaccagcagcataaagaagcggctgccgatgcgccgggactgtttcacaggaacgacaccccctcttctccctcgccaaagcggttcataatggccatgcaaaccaggacgatgaccatcattaccagggcgatggcggaacccagccacgggttataggtggtccccatgaactgcatctcaatgaggtcgcccagcagcaggctcttgccgccgcccagcagacgggagatgacaaaggtggacaccgagggaatgaacaccatggtcacgccggagagcacgccgggcagggagagggggaaggtcacccggcgaaagaccgtgaaggagttggcgcccagatcctgggcggcctcgatcaccttggggtcgattttctccagaacggagaggatgggcagaatcatgaaaggcaggaagttgtagaccatgcccagcacgacggccccctgggtgttgatcatctggaaggggccgataccaaacaggcccagaaagctgttgatcagcccccgcttctccagcaggaacatccaggagtaggtgcgcagcaggaagttcatccacatgggcagcatgatgagcatcatggccacccggcgcaccgcaggactctcctgggccagccagtaggacaggggatagccgatgagcagacagatgaacgtggcaatgatggccagtaaaaaggagcgcccgaacacgccggtatactgggccatggtagagaagttctccagcgtgaagccgccggcctggctcgtgaaggcgtaaaagacgatgatcagcaggggagccaccacaaagatggccatccagatgacatagggaacggcaatgcccttactcttcatcctcgtttccctcctccgggccctcattcagctcgtcatactccgagctgtaggagctgtagtcgccgaacataccggagtagcggctcttcttcatgatgtggaagccgtcggggtcgatcttcaccccaatcctggcccccactggggagaagtcggtggtctggatgagccacttgaagcccttgaagtccacgatgatgtcgtaatgcatccccttgaaggtgacctcggtgacagtgccggtgagctggccctgctccacggggacaatgtcgatgtcctccgggcggatgaccacatccacaggctcgttgggctggaaaccgccgtccagacaggggaatttcttgccgtacatccccaccaccctgtcctcatgcatgatgccgtcgatgatgttggactcgccgatgaagtcagccacaaaggcgtttttgggctcgttatagatatcctggggggtaccgatctgctggatacgcccttcattcatgaccacgaccgtgtcgctcatggtgagggcctcctcctggtcgtgggtgacatagacaaaggtgatgcctacctgctgctggatgcgcttgagttcgatctgcatatccttacgcagcttgagatccagcgcacccagcggttcgtccagcaggagtacctgggggcggttgacaatggcacgggcgatggcaacccgctgctgctggccgccggagagggaattgaccgaacgcttgccgtacccggccaggttgaccagggcaagggcctcttccacccgctcccgcagctccgcctcgggcactttgctgatgcgcagaccgaaggccacgttttcaaagatgttcatgtgggtgaacagggcatacttttgaaagacggtattgaccttcctcttatgaggaggaacgtcattaatcctcacgccgtcaaaaaacacgtcgccagaggtcggcttctgaaagccgccgatgatacggagcgtcgtggttttgccgcacccggagggaccgagcagcgtgaggaattccttgtcgttgatataaaggttgatatggtccagaatgacgtcgtcgtcaaatttcatgaagcaatccgacaggcggatcagttccttggacatgtatcctcccccatttctaaaaggtagtaaagggcgcacccaaaccggcggttgggtacgccctaatgacgaaacaaatcatatatgttcttgcgaaaaatgtcaataataaaacgaaatattttcagggattttatacccgctccccggtgggaaagtattccgccacgaaatccacctgctccacggtgaacacgcggccccgcaggtactccagcagcccggcgtcggtgggaaaggtgaaggccagcttataggaatagagggcctggaaggaacggccgtacttcttgttgtcccgctcccggccatacttgccgtcccccagcaggggatggccggcggcggcgaactgggcgcggatctggtgggtgcggccggtgagcagctcgcactccaccagggacagtccgcccgccgtccgcagagtcttatataaggtggcggcgctcttgccgccggggacagggcgggagaagaccttcacctgggcccggtcctcatccttgagtagaaagccctccagcttcccctgggatggcttcatgcggccgtggacaatggccaggtagaacttggcgatctcccggtccctgatcttctggttaaggatgcgcagggtctcggcgttcttggcggccatgacgatgccgccggtgttgcggtcgatgcggttgcagagggccggagtaaaggagtgctcgtcccgggggttccactccttcttctggtagagataggcctgaatatgggtgatgagggtgttcaccttttcgtgctcgtccgcgtggcacagcaggccaggccgtttgttgagcagcatcaggttttcatcctcatagatgatgtccaggtggggcttgaagacgctcagaaaggcgttctcctccctgggctgctcgaagaactcgtcgttgatgtataactggagtatgtcccccaactggagccgcacatcccgctgggagcccttcccattgaccttcacccgcttgaggcggatgtacttctgggccagcggcgcggggaggagggggagggtcttggccagccagcggtccagccgctgcccggcgtcgttttttccgatggtgaattctttcatagtctgcctcacaattcatttgcatccattataacataagcgcacaaccggggaaagaggggaaagggcttgcgcagcacggtcaagctgtggtatcataagaaggaaatccgccgtaaagtagtacagcctgccggactttgaaaaaatgtgggtttccacgaaaaaaatatttgacattggccgcgggtttcgttataatgtctgctgtgccattgtgtgaggtgtaccatgcgactggatctccgttctattcttcatgttcccggggcttcgctccccttctcgtttgcgttggatctgtccggcctggacttctatggagagcatccatttgccggcccggtacagatgtctggtacagtgcgaaatcaggcggatgccctcgttctggaggggacggcggagactacgctggagctggtgtgcgaccgttgcctcaagcccttctgccgggatatgcgcgttccggtggacagcctgctggccgagactctggaggacgaggaaaacgacgagatcctgcttctggataacggtacggtggatctggatgaggtctttaccaccgctttggtgctggccatggactccaagcatgtgtgctccgaggattgcaaggggctgtgcgccacttgcggcgcggatctcaacgagggaccctgcggctgcaagcctgaaattgatccacgttttgctgccctcgcgcagctgttggataaagagtctgagtaagttttgcccggccagggcatgaacctaaggaggtgtcatagatggcagtccctaagagtaaagtgtccaagcagcgccggaacaagcgccgtagctccgtgtggaagctggagactcccggcgttaccacctgccccaagtgcggtgcgttccgtctgccccaccggatgtgcaagagctgcatgagctacaacggccatgagttcggcaaggtggaggctaccgccgaggcgaagtaaatagcccgaaaagaacgaggggaatcacccctctttctttttgcccggaaatggggtagaatagaagcggtgagccgttgtgagcagcccggatggaccgcagcgagggtgagcgcagggccgcacgagcggcccggagaccagcccgaggcggagggaagccgggcgtcgcgaacaggcgaaccgtgacagcgtcgccgcaagctccagatccttcgcttcgccgcaggcggcaaagctcactccttccgctgcggctcctttccccaccgaacccgcggccgtcgccgctgggcttcggcgggggccccggaagtgggggagcgtaccgcgccgtatggccgggcggcggccccggagaatcgcagcagaccacaagggccgcccttgcaataagacgtaggggcgggtgcacacacccgcccgccgggccgatgaggacatcggcccctacgaaaagaaaggggcgggcggccgcagagccaccctctgtcactttatttttttgaggagcccaaaacgtatgagcctgacgaaaatcaaatccgtggacgcccacagtccggcccagagggcgggtgtccggccgggtgagacgctgacccacatcaacggacgccccattgtggatgtgctggactataaattttttgcttacgacccccggctggagctgaccctggtaggaggggacggccgcagccgcaccctgcgggtacgcaaggcggagggggaggagctgggcctcaattttgagacctatctgatggataaggcccgctcctgcgcgaaccggtgtatcttctgctttgtggatcagatgccccccggtatgcgggagaccctctatttcaaggatgacgatgcccgcctgtccttcctgatggggaactatatcaccctgaccaacctgtcggagcgggagattgcgcgcatcgcagagctgcgcatcagccccatcaacatctcggttcatgccactgatccggccctgcgggaggccatgctcaagcaccggcgggcgggggagtgtctggccatcatggagcgatttgctgcggcgggcatcaccatgaactgccagatcgtggcctgccccggcgtcaacgacggccccgccctggaccgcaccctgcgggagctgggggcactccacccggcggtgggcagcgtggcggtagtgccggtgggggtgacccgattccgggagggcctgtgtcggatcgacccgtacactccggcccaggccgcggcggtgctggatcaggtggaggcatttgccgcttctttcctgaaaaagcacagcacacacctggcgtggtgttccgacgagttctacctgctggccggccgtcccctgccggaaaagggatactatgaggacatggcccagatggaaaacggcgtggggatgctccgcctgctcaccagtcaggcggctatggccctggagaacatggagctggaggaggccccgccgccgtttgccattgccaccggcgtgtccgctgcccccttcttgcagaaaatcgttgacatgtgccgggaaaaatgtggtaatataataggaaatgtctatccggtggtcaaccgctttttcggggagaccatcacggtctctggtctgattaccggacgggatctgatagagcagctcaaggggaaggcgctgggcgagcggctgctcatcccggacagcatgctccgggcgggggaacggatcttcctggacgacgtcactgtggagcaggtggaggaggccctgggggtgccggtgacggcccttccggctgacagcggctttgatctggtggacgccattctgggcctgccggtggagacgcccgcctatgccctgccgccggaggacgactattatcgctacaacccgtgacagagagagtgagggtgctattatgaagcctttgattgcaatcgtgggccggcccaacgtgggcaagtccatgctgtttaataaattggtgggccagcggttgtccatcgtggaggatacccccggcgtcacccgcgaccggctgtacgccgaggcggagtggagaaaccggaagttcgacctggtggacaccggcggcatcgagccctccgccgacagccagattctggcctttatgcgccagcaggcggagatcgccatccagcacgccacggtgaccctctttgtctgcgacatcaagaccggcctcaccgcctccgaccaagaggtggccaacatgctgctgcgctctcagaagccggtggtgctggcggtcaacaagatggaccaggtggggatcaccaacccagacatttatgagttctataacctgggactgggggatcccatcgcggtctccgccgtccacggccatggcaccggggatctgctggatgcctgtatggagtatttcgcccctgaggacgaggaggaagaggaggacgatgtcatcaaggtggcgatcatcggcaagcccaacgtgggcaagtcctccctggtaaaccgcatcctgggggagcagcgggtgatcgtcagcgacatggcgggcaccacccgggacgcggtggacagctattttgagaaccagaagggcaagtacctgttcatcgacaccgccggtatgcgcaagaagtccaaggtggacgaccgcatcgagaagttttccgtcctgcgggccaccatggccattgagcgggctgacgtgtgcctgatcctggtagacgccaacgagggagtcaccgagcaggataccaaggtggccggtctggcccacgaggcgggcaaggcatgtatcatcgtggtcaacaagtgggacgccattgagaaggatgacaagactatggaccacatgcgccaggacatccgcagggatctgtcctatatgacctacgcccccattgtcttcatttccgccctcaccggacagcgggtggaccgtctctttgacctcatcaactatgtcaatgaccaggcatccctgcgcattaccaccggcatgctcaacaccgtgctggctgacgccaccgcccgcgtgcagccccccaccgacaagggacgccgtctgaagatctactatatgacccagatcggtatcaagcccccccactttgtttgcttctgcaacgacgccaagctgttccacttctcctaccagcgctatctggagaaccagatccgctccacctttggcctggagggcacgccagtccggctgaccattcggcagaagagcgacaaggagggatagtcatggcagatcctacaacagttcccacgggaatacagcctaaccttcccgccgcactgagtgagctgggggcggccctgttgcttccggccatgctggtcgcagtgatcgcctacttctgcggctgcttcaacggggcggtcatcgtctccaagtatatcctgcgggacgatgtgcgtacccatggcagcggcaatgccgggctgaccaacttctaccgcaccttcggcgggccgctgacctttgtggttatcctgaccgatgtgctcaaagcagtcgtggctgtatgggttggcatcctggcggcaaagtatttggtggcggatgagcttctggtagtggcgcttggtaagtactgggcgggagctttctgccttctggggcacatgttcccctgtatgttccactttaaggggggcaaggggatcctctccggaggcaccatcgctatcatgattgattggcgggtggcgctggtggtgtgggggggattcctgatcttggccgcgctcaccaaatgggtctccctgggctccatctgggccggggcatccttcccctttgccacttggtttgtgtaccatgacgtggtgctgctggcgctggccattctgctgggcggcctgatcgtctggaagcaccggggcaacctgaagcgtattctgaacggaacggaatccaagttcagcctgcaccataaaaaagatgagggggcgccgaaagcatgaagatcgcagtgatgggcagcggcggttgggggacagccctggccctggttctgctggagaacggacatgaggtcaccctgtggtcctatagggaggaggagtccactatcctgcgggagaagcgggaaaaccccatgctgaagggggtgcccctgccggatggactggcgttgacctctgaccgggagtgcgtgaagaactgtaaggtggttgtgcttgctacgccgtcctttgcggtgcgtaccaccgcccgtgctgtggcgtccctgttggagccctctgcggtgctggtgtcggtgtccaagggcattgagaaagatacctctctgaccctgaccgacgccattgctcaggaagtgggggaggggcatcccatcgtggccctttccggcccttcccacgccgaggaggtgggccgtggcgtccccactgtggtggtgtccgcctctcgagacaaggcggcggcggagctggtgcaggatctctttatgaatgagcggttccgtgtttacgcctccgacgacgtagtgggtgtggaattgggcgctgcgttaaaaaacgtcatcgccctctgtgccgggatctgtgacggcatgggcttcggcgacaataccaaggccgccctgatgacccgcggcctgacggagatcgcccgcttgggcgtggccctgggcggccgcagagaaacctttgcgggactgtccggcgtgggtgacctgatcgtcacctgtacctccatgcactccagaaaccgccgttgcggcattctgatcggccaaggcacccctgccgctgaggcggtaaaggagattggcgctgtggtagagggctactatgcggccgccaccgcccgcgccctggctcagaaggcgggggttgagatgcccatcacagaggcggcctatcaggtattatacggcggacgggataccagggccgtgattaaggagttgatgacccgcgcccggaagcacgagctggaggatagctgggtctaaaaaggttttcgaaaaaaatcgagaaaaattgaaaaaaacacttgcatcttttcgcaggatgtggtaatataatcaagccgtccgatgagggcggcgacttccgggtgtggcgaagtttggtatcgcgcttgaatggggttcaagaggccgctggttcgaatccagtcactcggaccaaacaatgataatccgaactacattatccaagtgggtaatgtgttcggatttatcatttctattgaatatgtgctttgatggacaagggcgggactatcaccccgcccttgtttttttagatcttttctgatattttgtgtctgtcagacaaatcaaagatttgcaattgaaaattatgcttattgtttcactgcaaggcaataattcgtattgtcaaaagcactcatttgatttttaggattggcctcattatagagcgcaaagtattgctctgttattccctggggctccaagtgctcatatatcaaaaattcatgtgctgaaagcaattgttcgatatcagagtaggaataacatgccaacattttttcgtttgcaacacccgccagcatgaattgcttttttgttcgttctccggctttttcagtatagctgttttcatctggataatcaaatataatggaactgcctttcgccacaatactacttatagaagaaattaccgattcgaaggattcctttgagagataataggcgacaccaagaatggaacagtaacttattttatcactattaaacgagttgtgattttgcatttctttcttccatgttccttttgtgaagtctgcttcaatgtagtgaacattgtcgggaattacaattccggcacttttcagccgctcttgtttatctcttgcggtagccggatggtctacctcaaaaatttgcaatgcctttgcccataatggttgccgatacgcaaaagtgtcatatccggctccccaaattaaatactgttctgttcccgtgcgaacagcccactcaagagatttttcggcaaaagccgccctgccaagtggcgagggagatagttgattatcaacaacccatcttaatgcctgttctggttctccaacaaatgatggattgaaaaatcctattccattcgacatattctttgctatttgattaaattcttcatcagtcagtaaatctcttgccaagctgtcattaaaaattgtaacctcattgtttagcgcatgatacgcccttgagaatgcgcttatcagtgcggttaagcttttttgctccattaaaaacacctcctgtatacttaatacatccttgatacaaaaagctcaagacttgaaatttccctgattttgtggtaatataaaagcacaaaaagggataattttatgaattttatagtaacgcccagaaataaactatggtataaggcgggagcatcgttgctgatgttcccgccttatgtattatgcctgttctgttgcgttggcgtcccgccgagccttccactctgcaaactcccgttgcccttcctcgctctcgaaaaggcttgaatttccgggagcaggacacgggccagggcttccgattcatggaggggaactcccgtgccctagttaaggcttgcgtgaatcgcccggccagctgtccattacctcccgaagctggctgtcctggcggtgcgccttttatcgctattcacgcgggggttgtatccgaaatactgtgtattcagttgtcagtgggagggggaccctcttatctattaggcggattttagggcaaaggtcctctcttgcagagaatttttcaaactattttaaatttagcaaaccttgctgatccccacgccctcgaccctggagattttttactgacgctgagaatgtaataagcatgaacgcgccgggcctggacaggcgggagttggacgatggctgcatggagggggtcccgatcttcaccggtctctagaggctgctccggggacagcggcgggtagggcatgtcggcctcaaagccggtgatcagtgtccatggaacgctcgccatgatcatgcttgtggcgcttgtagctgtcacacaggcggccaccaatgaaagagtcacggtaatttcgtctgatgcctccagaatgacgcgatcggtcaaatggggatagtaattgtttagaatgatagttttcatttttagtctttatttcggtgttcagcagttgacggactggcagatcgaaatggaggatggcggggagcggcgcccaggccagccgcccccacctctggccgcgatggccagaggtagtctggtataacaacgtccgcacggcgcaagaccatgcggacagatataacatgattttctttcgggcactggcagatttctgctacaaggccagacagggataccggcagaaaacgaccattttcgcagttgaccgcggaatggccccctaatagggccggactttctttgacgaataaccatcagtcagcttgctgcatggtaacaacatggcagtatcctcctataatccgccgtatcctgcgcataagtaaacggcagcttattgctaaaccgccgttagtacaagaaatccgagcatgagggaatatgtgcccagcggcggttttttctttcctgccgctgggcagataacttttgacgatttttacatagctgtcatcaggctaaatagaatccccctgtgaattttagctgtcatgcagacctttacgaaatctctcggattaggatgaagggggtaagctggcggtcttggcctgcgggattatctacaatcagagccaaaagccgagagtcgggccaattctggagctgttcactttttcccagaagttcgacagtcaaatcgttggcatccacgaccatcatcacaattccggttttgagatatacctcatcacagaccttatccggcttactgggaatacgaatcccaatatgcgcatactccgggatgtccctcccccaaaagccgtctagtcccctcacctcatcgtccagcatgtcgtaaaaagtaccgtggatgccgcggagcttattaaggccggcgcagacagccgccttgaggacctttcccaagccgcaaaagttgatggcaaactgcattttaacaggcaggcccatcccgggcccagccgccgtctgatggacaaagcgtgaaagaagcttggcccagaagcctggtttgacctgttcctcagtcactacccgcccttggcatagggcaatgactttttcgctggcggaaagaatatctcccggttggtagactggtatgacatatctctccaggaggtcgatataattctcgcctacctggacgaaatgtgttgtaatcgcatggcgggcatacgtcttgccgttagcttgaatggtaacggcctttccttcgttggcgtaaaaatccatgggaaagattcctcctatataatacgcaaattgaaataagtatcctggtacgttgcctccttactctccgcgctttctggcggggtacagtttggaccattttataaggcttgaaatgcccatagattgctgatttgcggtttcaaagtatcataatcccacagcatattgctccgctccgtactgttgggatcattgactgtaaactgtccgtcctttatgccggtaatcacaataaaatgtccggttgttgtaaaatctccgggccgcatactgcaaatgatggggcggccttccttcaagacaccctccataatcgattttgtcaagggcagttcctccccgattactccgaagtgcttcgctccttcgctcataagtgtccaggcagtcccagcgccgggaacatagtatccctgctcactggcgtattgggccactacatacggcgtaatggtgtcatcgcccgttaagctggtaatcaccatggataagcaggctggcccgcatccactgacggcaacggagctgttgccatagtcgccgtaaccccagcgttgatcgtattgcagaagaagcggaacttctcctacttcaacctctccgacagtttcagcaaaaacctgccctactttctctggatactctaaaacaaaattcagcatatccaggtttctggacagcattttcaaaatatcctcgggatagatttcgcagttatctatgacctgctgaacccgctgatcctggctcaccaagtcttgcagtttctgccagacctcatgatccatcggcgcctgggtaacatctgtatttttgcctactatcgccgtcccgcacgcatcatgccaggattgattggtgcccgtggaagatgcgtcgctatcattctgaaataaggttcctctaaaaagccagactcctgcgatgacaaacgcaaaaacaaatgcgcgccaaaacatcactacccgctggttgcgcttgtgactccgcctggttttttggccgaatgtttctttcataggtatgctccttttctaaaatgcaaaataaaccacgctcctgacagttatcattgtactgaacaggagcgtggcaagtttgaatattcagttgtttgtttcttgagaaaaacttgaggaaggatagatgttttctgaatctgccgcaggcagttgaaccgtaaatgtgaccgtgtcattttcgctcgatgcatggatcgtaccgccatgtaaaagaatgatttcctttgcaattgccagcccaagccccgtgccgcctgtatcagaggcgcgggattcatccaagcggtagaacttatcaaagagggaggacaacttctcagccgggattgtattccccttgttttgaaaaatgacgaagatatgtcctctcactttctcggtagagattctgatttctgtattcagatagctgtatgccgccgcattttttaatatattgctgaatacacgggccaactgatccgcatccgcacaaactgttaaatcttcatcaatttccagtttaattgagagcccgcgctgagaaaagaccggagacaactcatcggataattgtatcagcatataggagaggtctatcgactcttttattagcttgatttgctgtgaattgtacctagtgatttcaaagaattcattgatcatcttttccagccggtacgctttttccaatgtaatacgtacatgcttcacacgctgaggggctggcatatccggatcttcgtgcaaaaggctcaagtagccgataacggatgtgagtggggtacgaatatcatgggccagatacattaccaactcatttttccgctgttccgcaagggccgtttccgccttttgtcgctccagtgtctgctttacagcatttaatttactctcaaatggcagcatttctggtgataggcggatcgcctttgaatcgtccacctgcagagcgtcaattccctgatcgatctccttgaagtatttggtcatccatcggaataggcgcaggagcaaaaacgcaaagacgaatgtaattgccgctgcaaagaacacttccctgtaacttcgaaaatagtagaaatagatcatgttcgcagtttcacggtctactccaaaaaaatgcatcaaaaagtatgcaattaggtttcctcctcgctgtctccacagcaacacataaagaacaattacgataaggatcgataacaaagcgttaccgcaaaaacgacgcgtgattttagcccgaaatgtagcataatcgttgctgaacttaatcttcaattttataaccgaccccccatatcgttctgatatattttggattgtccatcgtatcattcagtttttctcttaaatggcgaatgtgggacgtgattgtgttgttcgttttactgtaatattcatccgcccaaatcctgtaaaaaagctcctcggcgctgacaaccgttcccttgctttctaaaaggatctgtaagatcgaaaattcagtaggcgtcagcgtaagtgattttccatccaacaaacactggtgtgcttttacattcatctccaaaccggcgtgggtcatgacatcaccggcctccgcttcagcttgcgcgggattgtattttttgtaccgccgcagctgagatttcacccttgcaactaattcaagcggacgaaaaggttttgtcatatagtcgtctgcaccaagtgtcagaccgttgattttatccgtttctccgtctttggctgtcagcataataattggatatgtgtgtcttgttctgattttctggcatagcgtatatccatctatatccggtagcatgacgtccaggatcgcaaggtcaaggtttgttgtgttgatacactcgagggcttcttttgcagaatagaatttaaacacgctataattttcgttgttcagatatacttcaatcaaatccgcaatctcgacctcatcatcgacgactagtattttgtccggcatgatacttcgctcctcctttgcatcgtcctccacatattgtaatagaaagggatattataattgttgagccttacatgagaaaatattaagattttcctcagatttctattgtgattgggggaatcgtcaactactattgtagcaaaatccttgaatacatcaaggataggaagataattcgattttttgcatttccgcaggtttgtggggtgcacgttagtatcaagcaaggcaagtgtatagacgcttgccgtttttgcaccgcaaaaatgcttgttggggtgcccccaaaccctctggcacttctggccacgatgaagccgctgacaaagtccccaattcggacgtacttgggctggacctcctggaccgggtgccggaccacagtcccgtctcccagctgcggtggaggaagccctccttcggcaagagcttccggcggctgtttgaggaaatagtacgccagtgtgtcccaaacggccctgtgaccggtcggctggtgggtaccggcttatgtgaaggccaatgcctcccgtgcctcggaggagctgatggagctccaggagagcccagggaattattgagaccgtctggacacctacggggaggaggggctggaggaaccggcccagtggaccggaaaacaccgttccaaacgaaccaaacagctcaaaaaggatagctgccacaccagaaagcgtgtgtgccacactgacccggaggacggccatctgaaccgccccggcaggccccggggggcccactacttgggccgccagacggtggacaccgaccacggcgttatcatcggcgtcacgggtttaaccgtgcttttcatgcgtgcgaaaaagtcctttgaatggaggacttgcaaatcggtgtcaaagggattgtcatggtggggctccgtgtcaggcattggagcgcccttggagataggagcggcgtgaccctgcttccggcgttcatgttggatagcctaagggtgtatcaaatggaaaacattagagaaaataagagggacgacaaaatcatttcctgccgcttcacggtctgtcttgggcgggacataaaatagaggttggtcacatcgtcccgcccatggccgaggaacccggccacggccttttgggccgcatagtgagatgttggcttcgtaccattcgcccgcgtaggtgtgtcggaggccgtgggaggccattgagcgagtggagtccggctcttgggcgtaggaacgaaaagcctggaggaccgtgatgtcctgatgggtgggcacactgtccgggataaggagcttgcatccctgtagcgtctgctcgagatgataccggaggcgtggctccaggatgggattcagtgaaaccggccgaccgctcttgcttttcaaaatcaaaaaaggacgcagtgcacccaacggcgcgggccgactgtttctggcagatttccgcgggaaactgccatcacagtcagcaccgggagcggtaaacgcattgaggtgactggaatgagaggatggaggccagccgggctcccacagcggccgcgcgtccttgggtgaggggcagatgatactgccggcgtccgtggtccgcccccggcagcaggacggaaagatacactggtatactggtgaaaccggtatggggagcgctcctctgcgccaggtttgtgttatccttttggacagaaaaaggcccgaaaacaattcgtgcttgttttcggacctgatgggtgaatattccaaatgaaggccggtctgtttttatctctgtcaagtctccagggagttggaataaatccacgggtgagaaatgccacctgataacggaattagcatagcataaaacaacacagccatatagctgcactttttactatcattctaattatgatgattaaaataattcgtctttacataaccagtagatcagggcgcaataagcccattgccggcgtacaaacattacaacgtgcacaacgcggatcaaagtccgacgaacagacggccagcaatccggcgcatgccccgtgatttcagcgagtgggtacaaaaatcaatcacagctttgataccataatatatcctgctttttaaccagtaaatctgtatgtagtatccggataggggcgcacttatacaaggtgatctgccagtcctccttaacttacaagtaaggtttaccacaggagcctgagggatgtataggcgaagctttttcaactgtttagaagctgcttcttgcatttccggtcggaacattccgtgtcccacgcgggcggcatgtattgttggaatgccgaataggagccgtgggagtacccggcaaggacgagaagtccagcggctaagcgagcatcctgtaggccgagagaatcattatcccatggcgtgaatacaggtggcgctgatctgtggggggatgctatgcgtcattactccgttgtagtggatgcatacttgacagccagggcaaaaacagagagcgttaccggcgtgcacaacgacggcttgattggtgcaatggtcgcacacaagaagctgtgaggcgcaggatctgcataccgtggcgtacatggttacggacttatctggttccacagtagaacctcctctcccaaatacggtagagtatcctatgaccgcaacggttgagtagttcgaaatggtccacaaaaagccgccccatgaaaggggcggctcaggactatagatcttccagatcagcagcagggaggtcattctccaggttatcccgcgccagatcagtgtccagctcggggtatgcgtcaacgggaatcggacgctcgtggtaaaccagcattgtggggccggaggtgcctgccacaatgggattggcctttttcttggtgtgcttcgccttgccctggagctcggggacgggtggggcgtcgttgtggggttgggtgtgcgtccgctcggggcgggacataccttgctttgccatagtatcacctcaccactagggtgccacgggcagaggtaaaaatacgatacaaaatttgaggtacggcatgaaattattgcagcccggcgcccattcccttattgcgggtagcaatcaagtccaaaattccgcaagtaccgcgcttgctgactgagcttgcggaaaaggaatcacgccggattcgctccgtcgcctctacagcggggatgaggtggtgctcatccaggtatggaaccaggtcggcaccagcctggataagctggatgtgtccaagtcggacacaaatggtaggagggggcatttgtcaatcttcggtgggggagagctctcccgttatggcgtccacataataggcgccgctgtctgtggtgatgcgccagaccggtgtgagctcgacaggccgcgtggtgccgctgacaatcagatagcccgcgttcatttcgtcaatgcggctgcacacaaagccaccctctgtcacaccggccagaaaacggaccaggactgtggcggcagagagggtctcttcctcgctggacgaggttacggtgccggacaggcgctggccctccatgcggagcagtgtgtcatcctgccagagcagggtgacctgacaggaaaaaaggggggtaccctcccagttctggtagtaggtcagtaccgtttgccccgggcgctcaccggactcggaggagatgagagtgccctggaaatcgattcgctccaggcatgactgggaggcatcctcgtaggagcgctcatgttccttggcccaggcaccaggttgaaaacgcactgagaaggtgccgttcatggagaattcagcggtgccctgtacactggaataccgatgccggacatcgttttccccctcgcgggagacatcgcccagcagagtctgcgccacgatggcctcgctttcccggtcgcgggtgacggtcagaggggagagtccggcctcctgggggacccgctccgggccgaaggtgatgccgctctgctccagaacgcgcacggccgcctggcgcgtatcctcctcatagcgggcggcacggctctcctgcacacccaccagaatcaggaggaaggcattgacggataccagcagaagcaggatgatgttttttaatttggaccattccacagggcatcattcctatctggcggtccagccggcctccacagtgtcaccgccattatccgtataaaagaccactaactcccttccctcgggagacagggcctccagcgcggcggcggcctgccgctcgggaagaagcaggctgtgctccgcagtctcctcatagcggcggaagcgcagggtatagtctatgatctgtccgttccgcaccgtgaaccgggcggcgcagccgtcctctggaaggagaacggccgctccgctcaggctgtagccatagcagacctctgtggtgccgtcggctccttctgtgatatccatcaagtagagttgggcggcgccgcaggaggcgcccacagtatctgcggccagccgccgggtggtttccaccagctccgacaccgtatagccatctgtggttccgatgggatagcgggaggccgcatcctctgaggtgtggtaggacacggtgccgtcattgccgatctccagagtttcccgtcctacccggaggcgcaggccgccagggatttcgtacagggcatcgctctgtgtctggaaagaaacagcggcctgaagggccgatacagtggcctcgtccggggaggagagggggttggcggagtggtacaccagggggctcggcgtggcggaggtgagcagtacataggggtccagcccggcatagccccggtccgcctccaactcaaagacaaaaaatgcaccgttgcttccgtggccggaaaccagctcgtccatatggccagtgtaggcgacctccgtttcacaggcataatacaggccatctgattcattatgatagtacagggagaccccaccatccagatcctgggccacggccaactggcgggctgtagcagtaagggaggggttgctgccgccctcgcccatccaggcgtatagggcctccaacgggagctctcccaggaagtcgaaccacacgcccggggcctgtagggcgtcccgccaggctgactccggaactgtatggggagaggcggcgctggagagagcctcgctgagcaggatgcctaccgaactgaacaggcggtcggcttgggctgggtcatactgaaccgcaaagcggtccaccccatcgcagacagcaatacgcacgggctgggcggcggctccggcctgtccggtcgcctcgggggcgtccgccggaacgctctgtcctggatttaaaagtgagagaagatgatccagccagccccgggggcccttatccaccagcccgttgaacatcagcacccggaccgtgagcaccacggcggagagggtgagcagcaggatcagcaggtttttaagccgctccacggtgtttcgtctgcggcggcgcacgcgcttattcccttccatggtgcgggccctccaccagcagggtgattcgtaccgtcagaccgggaccggagcggtccaccaactcgatggtgccctcatggcggtctatgatctccttggcaatggagagccccagtcctgtgccgcccgactcgcgggagcgggccttatccacccggtagaaccgctcgaagatgcggccccggtcctccttggggatgccgatgccgttgtcggccacttccatccacacccgccggtcctggcggccggcggagatacggatgcggccgccatcgggggtgtatttgatggagttggataccacattcatcatcacctgtacgatccgctcacggtccccggtaatctcaggcagctcttccgtgatgtccagctccatggcgtggccgtggcgctgggcctccatcaggttggcgttgtagacatcctgcaccgcctgtccgaaagggaagggggccagcttcagctcggcccggccggagtcaaagcgggagagggtgagcagatcctgcacaatgtgggtcatacggtcggattcgttgagaataacacccaggaagtttttttccgtgttgggagggagctctcctgcattgtccgccagcgtctccgcataggagcggatgttggtcaggggagtgcgcagctcgtgggacacgttggccacaaactcccggcggagctcctcggtcttgcgctgctcggttacgtcgtgaatgacgacaagaacgccgcccagacgctcctggtcaaagggggtgagcagaagctccaggctgcggccgcccacatcccgctcaccgtccaggtagccgggctgctccacggccaacaccccctggaggggagcaatgtcggagaagagtgtatcgtagttctcactgccgccaatgggaatggatcggcccagcatctcctcggcggcggggttggactggataaccgagccgtcccgggagaaggccaccacaccgtcggtcatatgcagaaagagagtgcccagcttggtgcgctcgttctccacttcttccagggtgcgcttgagctgctgggccatgtcattgaaggtgccggtgagcacgccgatctcgtcccgggaggccacctcgattttgtgggaaaagtcgccgtccgccacccgttcagcgccctcggtcagccgctcaatgggggtgatcagcgtcttggacagcaggaaggagagaagcacggagatgataaggccgaagatcaacgcctctacgatcagcgtgatcagctcgctgttgagggcggacacattggcgccgttgtcctgcacatagacgatgtagcggccctcgccccgctgtactgccacggctacgtccatataggcggcggcgggggagttatcgtcgctggcatcctcacccgccagcacccgcatcaggttgcgggaatcattgggcatcgcctgtccggactccttatcgtcggagcctgccagccagtggccgtcggtaccgtccagtacgtagtatttccggctgcggttgtcaatgccgagggtgctgttggtatccagaatgtgggcgatgctggatgcggcgtcctcctcaccctcgatgggagtctccaagtccttccagaagtccgggtcgccaaaggcctcggacatctgggtatagaagtcctgcgtgtagtaattggcaaccgaattgatcagaaatgcacctaccaccgtcatcagggagataatcagcagcgtcatgatgagcatgagcttcatgtgcaggcttcgaaacatggagacaccccctcccaattcttccaagagatgcaacggcgtcctgagccgaagcgttgaagcagtacccgatggcctcccggttatgatgaactacagcgctgcggagtcgtccgttccctgcacgccaggccacacggagactccatagggatgtaagatttcaggcaacgcgaattcaacctgcggcttgccttgctggagttttatgcgttgaagtaatagcccaggccccttcgagtgacgataaactgcgggactgcgggattatcctccaccttttcgcgcaggcggcgcacggctacatcgacggcgcgcacatcgcctacataaccctcatagttccagacgtgctccatcagagcctcccgggaaaagacctttccgggctgggaggccagaaatttcagcagctcatattcccgctgtgtcagctccagggggtgatcatccttgtagacgatcatcaggtcgacatcaatgacgatacggccgtgctcaatacgccgactgccgccgaggggagcagccgcgccggcggcgcctaccatctcattgcggcgaatattggcctttacccgggccagcagctcccgcatggagaagggcttcgtgatatagtcatcggcccccagctccagtcccagaaccttgtcggtctcctcttcacgggcggtaagcatgatgaccggtgtgctccggttttccctgcgcaggctgcggcatacgtcaaaaccattcatcttgggcagcatgagatccaggagaatcagatccgggttttgctccagggccaactggaggcccgcctcgccgtcgtaggcctccagcgtctcatagccctccttggacagattgaagctgagaatatcgacgatgtttttctcgtcctccacgatcaggatacgcttgttcatggcaattcctccacacactcacagtcccagcagcttggccttcagcaccagcgccacggttttggcgtccttgatctccccctgccgtacctgctccaccagggcggagaaggggatgcgctccacggagaggaactcgtcctcgtccggatgacaggctccctcagtcagctcttgggcgagatacatgtgaagcacctccgaggaaaagccgggggaggagtagagacaccccaggtaggtcagcctcccgcaggaggcgcccacctcctcctccagctcacgcagggcggccagacggtggtcctcgccccgctccaacttccctgcgggcagttcggccaccacctcctggaaggggtagcgaaactggcggaccaggctcaccgtgccgtcgtcaaacaggggcagaatagccaccccgccggggtgctccaccacttcccgggaggccacgcggccgttgggcagttccgccttgtccagccgcaccgtgatgatctttccctcaaagagcacgcggctctccactgtcttttccatcagttccatccggcatatccctttctttgcacagcctttgcactgcggcatccagattaaaccacattatatcatagattccgcccctttgccaatccccccaatcattacagctatccaaagtccacggccatccggtataataccatcaacggtcggattgatttttgcaaaaggaggcccgttatgacgatccagccaatcggaagcgccagcgtggcgctgtacatcacacctgcggacttgaaggagcacggtctcaccccggcagggctgactctggaacgggcgctggccattacacagaccgccttccacgaggcggggatcactctggagggctccatcgagatcgaggcctacccggatgcctgcggcgttctggtgtttgcccatgtccgcgcgccggagcgggcctggttttcttttgacgagctggagcctgtggtggccgcggcccgggatctgcccgcaccgcggccggatgcggcgctgctctggtgggaggaccgctggtggctctcgctgggagcgggggaggagcaggccattgcgcggctgtcggagttcggccgctgtgagaccgcacgcccccatctggaagcccggctggccgagcacggccgccccgtgtgggatcaggacgccctcaccgcgctgctctcctactttcccgtctgacctattgacaagcgtggtataataaaaacctaggcatatacagccggaacgcaggccgggggggaggacatggacggcaagggaatcaaggtggttgcaaagaacagcaaggcttaccacgattactttattgaagataagtacgaggcgggcatcgagctggcgggcaccgaggtcaagtccatccgccagggccatgtcaacctcaaagactctttctgtatcgtgaaagacggacagatgcacgttcacggcatgcacatcagcccctatgagaaagggaacatcttcaacaaggaccccttgcgctctcgccggctgctgatgcacaagcgggagatcctccgcctcttcgccaaggtaaagcaggatggatacgcgctggtgcctctgtctctctacttccgcggtcccagggtcaagttggaggtggggttggccaaaggcaagaagctctacgacaagcgggcctccgccgcggccaaggacgccaagagggaaatggaccgcactatgaaatcccgccgcaccggcggttattgatgtcaaagaggggggcatccccctgggaaaggaaggaatccaatggctcaaaatcccattgtcacctttgagatggagaacggcggcaaaatggtcgctgaactctacccggaagtggcgcccaacacggtcaacaacttcatcagcctggtgcagtccggcttttataacggcctgatcttccaccgggtgatccctggtttcatgatccagggcggctgccccaacggcaacggcatgggtggccccggctattccatccgcggtgagttcagccacaacggggtgcagaacagcctcaagcacgaccggggtgtactctccatggcccgcgccatgaatcccaactccgccggtagccagttctttatcatggtggagaaggccccccatctggacggcgagtatgccgccttcggcaaggtgatcgagggcatggacgtggccgataccatcgtgaacgcagaccgggaccggatggataagcccaagcaggagcagcggatgaagtccgtcactgtggagaccttcggcgtggactatcctgccccggccaagtgctgattttcaggagagctcaacgacacgactcaattccacgcagaaatgtcctgcaacctcatctctcccggtgaagcccagcgtcagcgggttcaccgggaaggtgaggagcaagggagcggcctgacggatgtccgcctttggcgggtgtccggaagaaagcggactttgcgacgagccgggggcgtactggtttcgacggggacgtagaggcgggaatagcgggcggatgcgcctatcatccttaaaatgggcagcttataaattaaagaacaacgataacgttgagcttgtcgcggcttaagccgtgaccgtcccgtccggaaggaccacgagccggaacggggcgtcgtttagtggtgcacgtgtgtgcgcaaagctttgagcgcaccatgaacaatgaagctaccaagccctgtagtttgacggcctacgccggggtaagggaatgtaaatgaccgtctgcgcccggagaggttcccgaggaagcgttttcggacgggggttcgactccccccgcctccaccattgagcgcatatccgaaccctacattgtatggggaaagatattcgttcaaacaaaaagacaccctttaccataacggtagagggtgtcttcctttattctccggtgaaaccgttcgctttggcacatttcagcgcacccaaaatcattttgtcctgcgccaatgtccgttgcttgatctcgtagataggtgtcccacagtgtccatcccattccacaatctgttttctgtcatggactaccacaccctcatagagatttatcagcttgtccagcgtcaaatcctttaatgtctgcatgattaccctgcactttcatcagaagatttgtctttgattttgataccaaagagcaaggcaagctccaccgtccacgcagagaaccaggccaccgtcagttccgatgaaatcatgtggtcgtggaaattggcaaccagaacagcgattgtgtaccagaacagattgaacatggagaagactgtgaaaagagtacgcttcttcaccttctttttcggcttcgtggcaactcgcttgccgctcattgataccaccctcactttttcaaataggccgcagaacagaacccggtataggtcactcgcttgtaggtgaacttgacatagagccactttacgccattgaccaccgtatagtaaccataattcttgaccacagttcctttcggaatggtagtcaaaaccttatgctccgtaccagcagcgttacgaatattcagggagcttgctgtcactttgtaggagccagccacagccttgttaaaggatttggcagtaccggtggccttgacctcggtaacgggtgcgggaacaaccgtatcaggctcaggtggctttacggaaggagccttatcgtattccacataggggatatgaccatgcttcttccaggtgcgggtattgtacccggctttggagccgatgttgcccaccgccgtgatctgcacacagttcttccacttaggcgtacactcgacaaccagaccatcaccgatgtagataccgatgtggccggtagtccataccacctcaccgggttccatgtcggcccagccggtggcagaagcgtcagggcacttggtaatcatctggtcggccccaatgtcgggtacaccgttggaagcgtacttcgcccctccgtaggtcttactcttgtcgccgcaccagccccatagaatacccttgataagacacacgcagtcaaacccaaaggtgtcctcggaagcggcgttaatcatcttcaaacgggccgcagctttgttgtaggaatgattggtggtgtaccgtttcttgttggccgtagtcaggggtgcgccaaaacaccccatgacatacagcgtcttatcgttcttcgcaatgtctatggccttaccgaccagctcacttgctttcatcatggcttacttgcctcccttgttatcatccaaaagctcctgcgtcttctggctctgagtgccgaagtaaaatgcaatgatgacggcataaatggtcatgaagtcctgactgatctggttggtgcaagccataaaagcgaacacgccggtcagtacaagggtcacaagggacttgacggacagcagattggacagacgcttgataatagtttccataatgcttctcctttctattttggtgagtttagtgacccattttcgatttttaccataaactctcttatagggacgctctctaaggggactttatagcaaaaacttaaaatcattcactaaactcactattgaccactgaaaataattggtagttacactaaaaatgttcagtcaaacaggcttgtgaaactcttccagatcggaaatgcggtggttaatgaccttgatttgctcttcaaccacgggcatacgcttggcaaaattgttgtgttcccggacttcatgggtgaggtcttccaacttcgtttccgtaaccgcttgctgtctgtccagtttggcgttcatggtctgagcggtcttattgctggaatagatggtgccaagcagagccagcccacccgtgataatagctacaacgattgcctctgtcattccactacctcccaagcctgagcgtaatcggtgggagagaagttggtgtcctgtttgcaccggtacacttttccgtctgtgaagatcatgtactcaccagtgtggtacatatcatgtgtgccctgaacgggaacaaagggccgagcggtttcctttgtcttaccatgcaggggccggttgaaggtgtaccaggaagagtcgccgggaatgaggccgggataggtggcattgtcgtaagcctgataacactcccaagtctgttcccactcgtttccaaggctgtccccagtatgggtattgtagatttcacccttggtatgctttccagcctcccaatcggggtacaaccctgcggctctgattttctggtcatcctccgtcacggcttccccagccagacttagcttcgacacatagattgcactcgtcaaagcgtccaacatcttcttattcacagcgcaagccccctctcaatcgccgccgcaatagcgtctacttcctcctgctccgcttttctctgaataatggcttcctgctctttctggtaggcaatctcactgatttcggtcactacaatactttccgtaccgtccagttctcctctgccctccacatggtacacagtaccctcaatcacgacaccctgagcctcctgttcactacacaggccatagctgccgttatcctgctttttgacccaaacagggttcgtaactgttgccagtacaatttctcctttgaacattcgatacatttctttcccaacctttcttgttcggatagaacccaaacatagatttgaaatactgattggttcgctcttttaccttataactgttgcctcgcatcatgtggccgttatagctgtccactgaattgcgaatatcagccagggtcatttcacccatctgccattttcggtaaaaagaacggagtttgcgccggatgattttggtagaagccgggttcatcttcaagatcaccttccctttcggtgtgacgatgaacttagttttcaaccatcggtagaagtccaccagagggacaatcctggtcttcttccagttaagccggagtccaaggtgccgagtgacctcttccaatcccaacatacattcgccctttagataatccaggttttcgtgaatggcgtagccgtcatccatataccgggcatatccctcaatccccaggacttctttgaaataatggtcaagcggactcggcaacaacagagcatttgtctgactgatttgactgcccaggccaagccctaccgggccaaaatccgcaatgaagctgttgtgtaaagcccgaatacggtcatcgtggagccgcctttccgcttccgccagcaagggttcatggggagcgtcatcgaagaagctcttgaagtcatagatcaagatgccaccagccagaccatgcttgcgaaaatgccgttccaagtgatagaccatccgccgtaaggcaaagtccattcctcggtgcttcaaactggcggagttgtcgtagatgaaagaggcggagtagattggcacaatgcagtaatcacataggcatttctggactgtccgctccgagatatgaacagagcgaatatgccgtttcttgccacgctccatgatgtagaactcatggaagcctcggtgaataaaggtgccatttctcagggataatagggtttcagagatatttgggataagattgctgatatacctttgtgtagaacttttccagtacactcctttacagcactttttcgcagagagatacagatgccggaacgaaaagacttcatcaaaatctccacaggccatacttcgctttagacgggcctcgtccctctttgctttcctgcgttgataacggatttcccttcgttcctcactcgtcataaaaaggggttccctccgtacagtattattgtggggtacgggttctaactgcatagtagtaccagccatgaaatgagctaccgtacaatcgctcaccatgcaagcagcgtccggctgactacatcggaagttcccgttgccggaaagggtatatttcaaacgatatacccggaagttttagcctttcggcagggtacaagccctccttctgcaaagggtactgatttcacccaacggggttactacgactgacccatacgaagttgcagaagccgaaggacacgccattagagttgttggcgttgttattgttggcgtttcccgaactgttcacattgcaaaaattgttggtgttgccgctattaggcgaacgctcccaccagttgttcgcagaacaataaacggatgacaggacttgacccatatctgaaaacttacaccgggaggtctttatacctctcgctgtcagctttcttcacttttgcgatcagcttcgcttcctctttgatgtactctccgaactcctgcatggcgtggtcaatccacgggcatttttccgggttttgaagaatagcgtcatagagtaaggtcagctttggactgagattttggagggcaatattggcttttgtcaggcagtcccggcgcatttgcgcttcatgctggtttctcggatagatattgtttgccgcccgaacctcgtcatgaaccgtggtagcaagagccatgagcttgtaaaggagataggggccgtaccgcttaggagccttggtgacaacggaaaaagtgtgagcttccagttttcttgcggtttcgatgaactgcattgggctttctccccgtttagatttgatgactgacataattaccctcctataccgccccttacggggcgggatttcgcagatattggattaaacgcagaagccgaaggacacgccaccagaggagtcggcgccgttatagttggcgccgcccgaactgttcacattgcaaaaaaagctggtgtcgccgctacaaggcgaacgctcccaccagccgtacgccgaaccgttgaccttcttaattctggtgttcccggccttgtaccaagcgtactgtgtaccctcaccggctaccgagtaagtggtcgtgccaaaaatctcaatttcggacagcagaaacaggtcatcattggtggtctgcgtaccgctggaactttcgccaccagtgccggatttcttcttgacggtcttgatgacattccgaagagctgccggaagttggcccttataggtagccattttggttctcatggcagagccgttccaacctccggtattggtattactgctattcatctgtgccgtctgattgaggcagtccacaagctggaatgtcatgggagccttaccaccagatactttatcgtcatggttaaaatcaataatctgtacctcgtagttagttccgccgatgtttacagtctttgtatctcccaccttgaagaatttttccgccatacccaggcgaccacaaatctcaatatcttcccaatcggtatcgttcagggtagctccgatctcgaagggatagacatagacgataccaatgacttccagagtccaagtccgagttttctgagagccgccaaaggtgtacttaatactccaatcacccaattcggcagggtagagaaccgcttcaccactggacacctgagcggtcaggactttactccccttactcattgtgacctgggttccgttgtctgcgatcacatgaacctcagcgggagaacccttctgacttagggcatacaaagcgtcatttatcgtggggtctgcctgggccagttccaaggcggctttcgtggtatcattcagcaaattggctttattcaaagcggtgccgatttcattgcacccggcgttttccccggttgtatcggtattcaaccgcacatcaaggtagccttgtccggcgagaagctgttcccgccatgcttcaaaggtttcgggcatatcagaaggggctttgataatgctggactttccattgcccttgatgctggtgtctttcatgctataagttcctccttattgtccacaatacatcgtcccggaatagcggaacgctgcggttgtctgtgtaattcgctggtcaattatccaaagcaaaaactccatgtcatttgccgtctgataggtcaacttgtccagagagttcggcacagacggagtattgtccggcagagagagctttgccctcaattttgtcagacagctcaggagatttcttacctggctctgtgttggggtatctcccatggcccaatctaccttcgggacaatggagctatcatgaatgtccagctctttcatttgctctaccagataggcgattgcctctccaagccggttgaagtccatgtagttataggcacctttcattccggccagatattcagctttttcctcagcggtgagggcggcaagccctcccgtgaggattttattctttagggtataaacccggtctacatcggcctgtgtgcggttgtagacaagctcattgataatactcatatcaaacctttcaccttcatctttccgctcagagagccgttaaaggagatttcatccaccaagatcagagcgtccatttcattggtgtatcgggtttgcagaccaataatgtcgcctacctccatctccgggtttccacgataatctgcatcataggtgtttcgcatttgtagataattctttacatggtttgccagagcaaggcacatactgtcattggtgattaagggattttcctccttgtctacctctccggtgagagctacggggtaggaaacgaccaccgagttctcctgcaaagtccgtccggtaatggttacggttttggtgccggaggataacaccaaatccgcaactctggcgtaaatgttggaagataccagcgttccgccagatacattgatctgaatatcttgtgcaagaccagagaactcaacatgaagctcagtttcggtggtcgtttcctcgtagagattggtgatactatcactggcagcgtaggagtaccgggccacggtgacagctcttaactcatcaattttggagatcgcctgactattctctgcgatagaagagaaatccagagtgaagtcagtttcccggtaatagaccttactaaccctcattctccgataagggagtccgctcagaaaagacacctcaattttggtacagtcaatcgccaaggaggaagacacaaacacctccactgaattgaccggaaccgtctgtgtgtccagcagaatagtgtccttgtaatacttcacctgaatagaggtgggatattcttccataggcgtatcaaagcggatagcgaccacaggaaggtcatgtgacacatcaaaggttttggtaaagaccggggccattgtaaatgtcccttccgcattggtcatggcttcgctgatatatcctctcccattggggtcatcatcagggataatcacctgattaccgccgtccagcgtccaccggttcaactcaaatacggcataagtgttctcactggtattgcccttgtccaccgttccccactcgctgtaccagagatggccgttgtcagcccactggccgctgtaaatgcccgtcacagtcacaccgaagggtttgatatggatgatattgtcatcgtccgtaaacaggcggcaacgggccgcatgagcgattaactgcaagcaattcatgtgtgtgtcgatgggaagagccgccgtagtgaacatctgcttcaagctctcgtcaatctcccatgggtgtgttccctgttccgtcagggtcaaatcagcgtccaacagaacttcttctgccatggcgaacaggcttttagagccaagtttgcttttgtagaaggttttcgtcagacttccaatcagaccggttccggtaaaggttgtctggttatccttggtagtgggcttgccgttcagcacatacctgtcagatttaatccactccacagagccgtccggcagctcatagccgaattggatttcaatgggagagttcttatccacataagcgtagatgccagccggattatcggggtcataattgtgttcgtagtcaatgatggtgaactccatcgtttcagttggcagtctgcggctcagagggtcaacatcatgcttttgctgagtggaaataatatccttgttcacaaattgcttgttcaggccgtatagaacctcttccagcctgggcctccgatatggcagagccatgtcgaaggtgatcgtcaccttgtctacctgggccgctctcgtgtttaccacagcctctacaccggtcacaggtactacttgggtatcaaccagggcattgcccaggtaaaaccttgcggtgatctgcaaaggccattcctgataccgggtatcaaaagtcagtgtcagaccggggaaggtgtggggagcagagaactgtcgggtaataactgccggagtgctgaacgctccctcagcgtcactcatgaggctggacacaaaaccgtcctgcaccgctccactggcgggaagaatgagagctttaccatccaatgcccacctatttaattccaaaacggcatagggactcccatactgataagggtaatccaccgtttcaaattcagaaaagggcagctccccattgcttacccactcaccgtctgttgcggctgttgtgtccacatttccgaaggtaatacggacataggagcggttgcgaaggaggccacgcatactcgacttgtaagcgttacttacagatttcatatcggccctcctttacaacggctctccgcagtcaatgagattaactttgcagttaatgtaatcaatgggaagctgtgtttccgggtcaagatggaatggctctgccgttctgtcaccggggtacatcttccgggtagtccatgtgttgttcaccatatccgggtaagtgaccatcacatagaaatttctaaattcttgcaacaggctcgaccactgttccgcagtcagataagcccattccagtttgtcgattttttgctgttcacggcctaccacctgacccaccaccacagcatttgcgtttctggcggagtccacgatggtagcggtcatgaggttaagccccctgcgggggcaaggatattcacgaccattgatcttgataaatgctgccatatccttacccccttagtaggcgttggcaaaggcaccactgttcactcggacacctctgctccggttgtaccggtcataagaccggccaattacatcatcaccgatggacacagacaaatccttgtcctcaatgatattcatgagtgcatagatagcggcgatcacgccgtcattagcaacggacacgccagcggaaataccttcaacgatctggtcattgttggcaacagcggtacgccgtcccatggcacccaccatctcagctccggcctctctcgcaatgaagagctgcccttcatccacgaaaccgccctcagccatatactggatttggtcaatggaaatccggctaaaatagctcaggctgatacctgtaatccaagaaacagcgttgatagagcgaatgacttggttgagtgcgttgatggcattgttcatgcctctttccattgcgttcagagtagagttccactggatgatagcggtattggtcatgcctctccacatggaactccaccccttcgggaaggtggtcgtaaaatcgtccatgccagtggtcatctgcgtttggaagtccgtgaagccgagaagcgtatttgtgcggaaagtagtaaaatccgtgttcatggtgtccaaaccggtctgccacttctgcacaaccccgtctaccagcgtattgaagttggtgtcaagggtggtcttcatctgctccacattggcttgaatgagaggcattttattggtcatgccggtggagaagccagtcacaagctgctcaccgcagacttgcagattggtaaagatgccagttgccagatttgccgtgccgttttcctgcgtcagaataccaagctgctccatgagagcggtatactgtgtcagcagggttacagcggtttgcagttccgggtttgcaagccgcagttcgtcattcaagctcttagtatccgtgtagatggtgttcacatcatcagcaaagtcaccgataggattaccggcaaagagcttctggaagccgctcacaatgctatcccaggtgataccacccatagagtcagtataggaactgatctccccggcaaaggtggacatgaaatccacaaaatcggacatatcatcggtaagctgaggaagagtgctgtttaagtcccggagagagggggcaaggttattgttcaattcgtccgcaacagctcgtaggctttccaccaaaccgatacaagccagggccatttctgccagaataccggctcccaaggcgattgccgcaggaagcaaacccgctgtaccaatagtgattgcgccaagagctgccgtcacagtacctacgccgaccaaaaggccggtgcctacaccaatggcagtagcaatctcttcgccgttgtccaaaaccggttgccatgcctgaccaatctcgtcaagtcccttacctacggcccaaatttctaccaggaacagaccagtagctacaccgagttccagtaagatagcggttccgataccgatattcaaagcaatggtcttacctccggttcccagggcgtatgcggctaaaccgaccgcacccaagataccagctccaataccgattgcagttgcaacggtggttccgttttcaatgacaggttcccacgctttgccaacttcttcgagttcatggcccatgatggcgattgccccggtaaagatgattgccgccgcagcaacttcggcaatgactaccacaccaaggccgaggttcttcgccagagatttcagcttgggggagagctgggtactaacggtagtatcaatcgttcccgtagcattggagagtgtgttcatagcggtagtggcattacccaggttagagatacccttcaacttggaaaatacatcaagagcgactaccaaaccgcccaggatttccaaaccgccaataatcagagccaccttgtccacaccgctccaatcgccttgcttgatagcgtcccaatttgttacgatctcacggatgatggtggtgaagccttgaatggctacgctccatgccgccaacttgatatttccagtaaacacgccgataccaatggcgatattagtcagtcctcggatgacagttagggcattttccgcattgacaccattctccgcaatgtcgctgataccaatgacgatctcaccgataccctgaataactttcagcgcaccgccaaccttcaaaccgccgagcataatcagagcgtcccccaccataccggcaaaggaactaatcataccggcaacattctggaaggtagggccgttgtccaggaaatctttcagatacctttcaaattccttcaaatcagcgaggaacatggacaagccgagaactttgaagtccagtttgaaggcaaaattcttggagttcagttctttcagaagtttcaaggccgctaagaaatctttggcgaccttccacgccaaaatacccgccgcaatactggtcacagtggaaagaacacctttcaggttttctttcagttcgtcaacctgggaattgatgttctcaaaaatgctctcgtcccacagtttaccgatgtcaaactcaccctcgtagcctccaccggaaacaccggcaccagctcccccggctccctgattagggtcaaaaacattcagctcgtcaaaaccagcggtgtactgtttcagcttctttgcggcacccgcagcgtcgccgaggttatcagccatatccccggcagcggaggcaccggaactgactccaaaatcaacaggcttcaagtcaatgccaaagagctgtgccagagccgcaatcgcttccccaatcagctccacaaaggcttgcacatagggtaaaaccttcaccaaagcaggaagaaggaaagagccaaaagcctgagatagagaggtgagctgttgacgcagggttctcataagaccttctgcggtagtcatctcacgggcataagtgccaatcaaattctgtgccttggcttggtcgatcagggtcagataccgcagataggacttcaattcctcgcttgcgctttgagtgctgtacgcaataccgtaatttgccgccgtgattttcaactgagagtccacgatggtgaaaccagctctacggatgggttcaacctcaccggcaatagcagagcgcacagcaacggcagcgtcttcaaaactcttgtaaatgtcgttgtaaccggcccaaatatcataagtcagctcggtatagttcatagccatagccgcagcgtccttctgtgcgacaccgaagcctttcagcatagtgccgtagatggaagcatactgcatgaactgttgaacattgattttcagctcagagtttagacggttaatccacttgtaattttcttctgcctcttcgccaaaagctcgaccaaagcggtacatgataccttcccattcggaagcctgatacatatatccggcaagtgcggcaccaattcgattagaggcgtagagtaccgtggaaagtttgatgcctgtgagagcattagaccacgctttagtcccagtagtggcccggtttacagaattgttgtaccggtctgtgctggcaatcaacctctgtattctggacggaaaagcggaaaatccattggacaccttctgcatttcatctgcaaaaggcttcatagcggcggcaagctccttcatctggcgagtgaacttgtcaacatctgctttttccaactcgtcaatcagtgccgggagttttccgagctgattgatgaaggaagtcatgttggctcttccaagctcagacagaggacgcagaccatctacaagggctctgatcttgtccccgtccgtccacctgacatttttcagggcggcattgagagcgttaagctgattagggatagaactggaaatcttgacccctctgacctgttccaatgctctcaggccggaggcaatctgcgtcaacttccgggacatatcaccgctgttcaggccggagagagcgttcttcaattcccgaatactcttgctggtgctgtcaagccccttgacgctgctgccggtcacagacttcaatccgctcagggcctttttcagattttcaagtccggttacggctcctgcactgttctcttggatttgaaattccaaaccctgaatttccacattatcagccatttacgccaccacctttctcctgaaatttcttattgaacgacatagccaatgcttggaaataggctttcgccttttcgtcctgcttctcccgtttggcctgtttcttttcctccttctgcatggtgttcagcgcaaacggctgatcgggataaggcacagccttagtgccttttttcgcaaaagctcggaggatgggggccagattgccaatcgcctgatagatatacattccttgcaaccacgcatcttgatttttcaaatcttgccggatttttgcggccttgcggtagtatctgacaagctcacaatctccgtcccaatattgttcggcagtcataccgattgccaagtagaaggggaatacttcataaaacttttccgtgtaagcgaaacggggagcggggcgaactacgccaccgccccctcgttcatcggactgcaacccgcttaccagttggcagtccagtccatgtttccctcgccgccctcgtcaggagtaggctcttccatcagagagagaatgggttcgttatacatttctaccagcttcggcagaagctcgtctttccggggcagacgggcataaatgcggtcaatgacctctctctttacgaagcggtgccgagcgataaacgcaccagcaaatagggccgggagcatggtcatgggcttgcggtcaacatcgtccgcaatgaagccctgcttctccatgatctctacggtcttgcgggtatattccagcgtatagctctcgccggaaacagggtctttgattgtcagcgtcttagccatgataaatcctccttatcgtcaggctgttgtgattaggtatcagagaaagtgatgggagtagacggggcaatggaaatgttcatgtccacaacctcgtttacaccgccgcccacggggaatacggacagttggcccttaaaggcgaacttgccattggaaccatcaggggtaacagcattaccagtcccggttccaccaaaccagacggcatagctgtcttccttaccttccagctctttcagcttcttaaaggtagccatgtcgtagtttgccgtgaaggacaggccatcaagggactgaataccggcaatataggtctgcatattgtcggatagtgtagtggtttctaacatttcgggttcgccgccaaggtcgggaaactccttaatgtcacacaacttggaataggtttcatcactatcgcctttcttcatcagaaagaccttataggtgctaatcgccatttcaacttacctcctgtaaagatttgtaccgtctgtttcggcccgataccgagctacaaggcggtagatacttgcgttctctaagttggggatgggggacagggaaatgcgggtgaaattacgctggtacataagatcatcaatgaccttcatgatgttccggcattggcttttcttgctggtcgatttattggaatagacatttacctcatacatcagcgttgcgaactgctctttgtcgctggtactcaggtgttccagagtagggtaattgtcttgttccacgatgctcacatgaggaaaagcggatggagctttcacatactcgccgctcacatcaataccaggaaaagtttcccggagggctaccgcaatcggtgtgtagatttgactctccacatcaatcatcgaaatacctcctttgccagtccgggcaagataccctccaagtgttttacggtttcatacatggacatattggccggattgccttgggtgatgactacttcctttccgtcctttttagtgtgaataacaccattagtaccgggttctccatagtaaccccaagacggctgcttaccgtgacctaccccatattctccacggcgcataccatgttctgcggcttccgggtgattatccgggtaggtcacgccggtgccgaactcaatgaagagtaccgatgcccccacagcaaccacggcccgaactccggcccctctctgctccacagacacagacacatcattggtgccgtcatacgctgcctttgcgaagttggcagaggctaccgatagaccttcttgcgccaatctgtccaacagaacacttgtctttgttttcaaccagctttgataccggttaatctctcgaatggcgttgtcaataccggccacggataaaggaattttgattgtcttcacgataccgtcaccttgctcacagcgtaagagatggaattgaggctccttgcaacacgcttcacgatgtagtcataaagaggatttccgtcatcgtcatattcaggtgatttgtcgatgaacaggacggtattttcgtcaatcgggcaagtaagatcgtccgtgacaatcaccttgtcataggagatgaaattgccaaactgttccacctgagctgaaccggttgcggcggaaacattgtcccgccgttttacggcttctttgtagaccacacgggtatcgcccgtttcgtgaccctcttcatcctttaccggctcttttctgtcatacagcagataccagtaagcagatttgttgcgctccatgactctcatatcaccggctccttcctgataaggctggcacagggaacaatttcacgcaggagtgtaggcggcacatctccgtcctcataggaacgagaaataccgttctcgctgtgtgccgtttctccctcagccccacgcttgttcaccagataagcggcgatttccacttgattgtaggcatatcggtctggaaccacggtcacggtattgtcgaagggataagcccgtttcaggactttgtttccagcgatagaaaggtaggtggaaagtacactctcgtccttctcgccggtcatagctttcagcatggtcagcttttcagtatcggtcatgacttttcacctacctttcttcaaattagccgccagctccgacttccttggtattcacgggattggactcgtcattggcaatgaacacgctccggctgtacttgggagcggtaaagctctgagcaatgccggtaaacttgccgtgataccactcagggccatggtcaagaccaatctggccgaagagctgatacttctcaccggcaccgatcttcgccagaggctccaggaagaagttgccctttccggggacaggctggtacacaggggcgatcacattcaggttcagcagcagagccgtaccagcgggaagacactcgcccaggtacagatacaccacgccgatgggagtgaccacactggacagagcgataccgttgatctcacgggcagcgggaaccacggtaaggccattctgaacagcgtcagcattgacctggaacagcgtggtagcgtcacaccacaggcacagaccatcggtgggagcattggcaccgtaaatcttcttcaccatgtcagcaatgtcccacaggccgagaggcttgctggacatggccttggtgttggtggtaatcgcctccaccagtccacgggtcttgttgatggtggcatcagaagtggccttgttgaaggtgccctgaataaaggtaaactcaatatctcggttgaccttctgcatcttcgccgccacctggaagtccagctcattgatgggattagcctgctggttggcaacattcaggccagacagggtgcccatgttggactgcttggcataggaaatgcctacggcctccatgaaaatctgagtcacattggtcttctgagtgcgggtaatcacacttgcctgcggtgccgtcagagaagcggtttcactgatagcgggctgctcaccgccgccagtggtgtactcctgaccggtcacaaactcgacatgattagtagtcttggccctgccgccgatgatggaggacagggggcaacgggtattacccttattgaagagcataccggagtaattcaacactccgaaactggtagccagagtatcggccataaatcaatctctcctttactggttattcacccttagcctcggcttcggcctgggctttcaggcgtgtatagtaggcaacagcggtaatatcaccgttcttctgcgcctcttcaatcttcttgccgtaatctacggcaccctcagtgccagagccggaaccggcacccgcaccgggcttgggggtctttttgattgcgtcagatttgaccttcttcgcatactcttcaaggaacttgctctggttggcaaagaccttagcactatcgccgtcagccagggccttagcggtttcctcagccagagcctcgtcatagccctgggctacaaacttggctttgtactcggaaacggtcttgcccttacggagatcggcaagctcctgttccatctgagccagcttgtcagcgtcttcctgcttcttcttttcctcttcggacaaaagagcattgtgcttccgtttccactcagcggcctcagaattggccttggaaagagcgttcttctgcttttccagctctgcggagttgtcctcgtactcaaacccttccagagcggccagcttctgctcaggggtcatgtttgcatacccctcaatcttgctggtgtcaatctttgccataacaaatacctcctgcgtttaacaaggctgttcactcagcactattttccgtttttggtggggttttctccccttgcgattaaggtcttccctgaccattcaaagccttgcggccttaaaaccaaaagaaaaagagctaccggcaaaagcgtttccgctcttaccgatagcccgtagtggctgttaccgtcatctctctatgacggcctcatatttctttttgctggcggtttcccaaaccaccactttgccgtttctcacagcaatctctactcccttgccacgagagaggatttcattgatctcctgaactgcctttgctgtcaggttcactaccgggttcatccccttcaccctccctattattctgttgcttgacggcaagctccaccgcctttttctcctgctcttccgcatactccatgctcattttgtaagcaacctgggggtcagagaacattccgcaatggataaaggccagaaccggagcaattttaggattgttcagcatggtaatcagcacattggccttttccgagatattctcataattgcggcgagtgaaacgaatttcaatagcagagagcttcaagctcagatcgctcaggttgtcgcagatgcgaagaaggattttcaaaaactccttctccgacttcttgaacatcaattcactgtccttggctctggcttctgccgcagaccaaccatctcgcatgatgacggcggaaccggtgtcactggtggaagaaccgccatttcggttcggcataccgcagatcgtgagaactgtattatacatactgtctacaagggtctgcgtttgcgtctggttcagttcagcagtcaggtactcaatctcggccttaaactgagggtcaatatctttatacttgattgcgccctcttcccgcagatcacgataatccgaagaagaaatatcgacattgtggaaaagcataagagcctgaacaaactgctctacgccgtccagtcggttagactccacattgttgattgcgtccagaagagggaggacgatttcaaaagcacccaaacgggctttgtttgccgggtactcaatgatgggaatacccaaatactgttcctcgctccgcctgatcgcccatgtgttttccacctcataatagtggtcggcggtgtaacagctaaagaccaacactccatcgtctttcaggatatattgaacacccatcatggcgggattgcccagggccgtggaatagaccacaaaggaatagcgagggtcaagcgtgaaaatctcaaacggagcttcgtcctcttccacatcagccgtaccatcgggaagaaccatgcggtaggaagttccacaaatgtgcgaccaatcagccagctccttatcctttgcggccttatcctcagacaaagcataatcattgagttgcgtgattttcttggcaattttctcgtcatccccacgactgacatactggacaggctcacccatcagatagccaaccttgaaagatacgatttcattggctcggttctcaacgactttgttattgatttcaggccgtacttctttctgccggtatagaaccggctgatctcccttgtagtatcggtacagataactaatatctgcctggttcatgaggtgaatgaacagggccttttgcagaacatcaatgatgttattatcgttgattgcggccacatcggtataaatcaccctgcggccaaataacgctctgcctcccattcatgtcacctcctatcaaagagccattttatcatctttcatgatagcataatatccaatgcttgtcaatgaataactctttataataccattggatatttagtttttcaacatggccgcttgaagatttcgattttccctccggccaacatacgaatttcgttttccagaagagccagggagtcaggtgcgtcatcatgtggaaccttgccgcttcgggtataggtggtcagctccttcatgaaattccaatactgactgcctcgtttgtaagtggacgggtgcttaaaatagaagttcttcttgatattgtcggaagcaaattcaattcgagtctgcttatttgaaatcgtccgcttcgttctgataccgatggagtacccttgctgccgaatgatttctgccacatcacgggcataatattgacctgcattgttggcctcaaaagtagcagaagcgaccctgttggagatcaggcatttggcacactccggttttgttacctctgcgggagcgtcatcaaagaccacatcgacaatataaacctcggtgccgtagataacggccaccggaagggaggtggagtctgaaccactctcggcggtatcgcctacggcaatgatggtgtccggctcccggtcaggaggcagctcaaagaaataattcaattcatccttgttgaacagaagacccttggcctcaaaaggctgttgctggaactcactctcaaactgctcggcggatagaagttccctctgttcccggaaatatgccgtggtaaaaatcttctgaccctctcgctcatactcataattactctcgtccgtgattagatcaagggccggaatttcaatggctctccaaggccaattctcctgtgccgcatattcctggacacgcccaataggatcgtagatggagtatcgggtgccagtgaataccatgggcgtaccctcaatggctcggcccataatatcaccagaaattacttcccatttatcatcaagccgctggcggttcttcgcctcttcacggccctccacacagtcatccagataaagcacattcgtggcctcggacaaacctacctgacgggcatcaatggaacggcacatgatagtagggaaccgggacttggatttgaggttgatgatctttgtgtccgctccggtctgcaccagacgggcatccgggaatacatcataaaatagatactcattcggagccatcagatattctaagcacccgttatagaagctcttcacaaggtcatcaccggttccctccatcagtgtagagcggtcagggaatttgccagagagcatattaacaaaattgatacccgtttgcgactttcccgctcgtttcggcatggatattgttaaaagacgcagctttttatcaagaatatcttggaacccctgcaccatgggtttcaggtaatgcctccggggagcataaaaccgcttttccggcttccggtcaagctcaatataggtcataaaagcgtcaaaattatggggagcatcaaacaagaggctcttcctccatgcctcataaaaatgttccgcctctttcggagaagtacggcgcaactgcttggccgagagaacccgcagctctttactgacctcatgcgccgcttgaaaatcttccgcttcccactggcggcaaagggataacaggtcaatataggcggcatgatcttccggcctattcccaatgtgccgtttaatactgtctgccagcttccgataatccataaaatcacctcaaaagaaaaagggctaccagatttctctgatagcccgtaatggctgttactcccgcccttgcaagagcctatttgctttttcacttattcgcttacagggtttaacaatagatttgccccgatagataattccaaatgggttccgtcctctacgataatctgttgactttctccatactcattgaagtaaacggtagaacgaacatcttctgaactgtcattgcctactacgaataccgtagctctatccttttctccttcgtagataacatcgtattttccagccggtatgttgtaccatacataagtgtaggttccaaaggtttcactgggtacggtcacttcctgtccatactctccaagttcaccatctaccaaccgaattgagttctcagtcaccatctcttccaccttttgctctgcctcttcttgggctttccgttctctcgccgctccgaaagggtctgcctcaaagatgaccatgagaaccagtccaatcaataacagtcctccgatgaatttcaaaatcaatttcatgcctcacccgacctttcgcaccttttcataccaagtgggcctactaataccgagttgacggcaagcgtcattcaccgtaatcagcccttctctttgcttttgcaccagtgtcttaaattcatccgggtcaatctcataagcagggcgaccaaacccccttcctgttttagcagatacctttctccctccaactactggcatagcggctatcccctcagcttgacgcttccgtatcttcttcctctcctgttctgccattgctcccataacttcaatcagaatgttattgaccatctcgccaatccaatcctgcccatggaagtccatcagcgtggtaggaacatcaaacaccctgacaataacaccatgctccttgaaccactccaactcggcttttatttccgctttattccgtccaaaccggtctaattcctcaaccaaaatttcatcaccgggaaccaagattgattttagctttaagtaatgttcccggttgaaattctttccgctttgcttatcggtgaagatatggtcatcgtccagatcaggagcgtaggctttcaaagcggcaagctgacgggcaaggttttggtctttggctgatacccggccatagccatatttcacttgccatcaccgcctgaccccaatagagcgtccaggtcatatttcgggtcttccttctggtcaatcaggatttggtcagctctgcggactccgggctttctttcctgaatgaccacctcataacccagggcggacagcatttcgactgcgctgttgaaggacaggttagtgcttcttaaccgagagctgatttcattgccacgctctttaccaagagcctttgccatggtcagaagagaaacatttttcgctttcatcaaatctcggatagccttgttgatatacatggtaatcacctcttgatgatactatacactgaatttattttgttgtcaatagggagttgaaaatattttgttactgaataagatttgtaactgaattggtttaacactgaatatagtttgttaggaataaagcctttttatttttgtgggaattttcgccactcaccccggcccggtggcggtggatatatcccccggccccggtatcaggcaaccggccccggctgcactctgaaaagcacaaaagagccgccccggaatgaaccagggcggcaacttcatttatttaattttatcaattcaatgattatttgaaccggtaaaagcaagatcagcagaagaatatacacgattacaccgccttatattgtggtactctgataaattcatcaaatgcccacataacaatatcagacggcgcacaaccggccacggctgcaagctctttctttataccctcttccgtatcggctacaatatagcagctatatccgtttacctcttctggcccttccggggtattctcttcatcgtgtataatccactctgaaccagtgttaaaatacattgtttcaaaagcggccaacgcttcccggctccaatcgtccacggggtaaaaaatttcgttccaatcactttggcaacaaccccgaataattcgccaatcccatttacggcccgtaacaacggaaagaaccttgcataaaatattgttctcttcccggcttccggcttccttataggcgtttacaagctctttcagggcgtgaatatcacgggtactatatcgggccttgtcaggctccaaaaggtcatttatcgcttgtgtagcgttcttgtaaaagctgctataataaccgccgttctttatatcgtccagggcttcggctaattctccatcttccagggcactatatacccggtcaaaaagtgagcttgtacggctgatataatcccggttgccggttacattgatataatccggccccattccttcatcttcaaacaaccggctttcctgatattctggcggtatttgtttgcaatagatcataattacacccccttaaaacaaccggaacaaattagaagagcgagccaaaataacaccgtattcccccgtcactttatcccaaatcaaaccgccgttcatgccgtaaattccacggctaaccccgattttttcataccatttaggcagcgtgtccgggtcaacctctgttagatcacgggccagccctaaacgggcatactcttttaactgttttcttgtgtattgcttcatcgtcccgccgccccctttactaattcttgatagattaaatgagttaaaagccgttccgcctgttcttctgtatattgcgcccattcccgctccgactgctcccaaatgttccccaggtcaaccacggcggaacggttatagtaataacaagtatctaacacactgggcaagccctggcaccaatccataaataccatctcattagtaaaaccttttgccgcctgatattccggggaataggctttttcactggcgtgaacttcgagaataaaccgagccacattttgaaaactgcaagggccggtgaaatcatacccgcacggctcaaaatgatctaaaatgtattgccgcacattctgacgggcttttttatttgttgtcttcattatgcgcccttcctttccctatgctttttcaatcgaaccgcaaaccgtccacaagaattttcccgatattcttttaaccgcttcaccgcttcggccctggtatattcgcaatcttcaacttcccacccgtaaccataatttgtttcaatgtcccaccggtcaacggtttttctaatatacgccataattacaccgcctttccgtttcctatcttgtgacctatgatctttccggctgcgtcatagatataaaccggattttcacccgttctgtgaggccgctccaccggtaatccgttccaccaggctttcccgccgccgtcaatcccgaaaaaggaaagaaaactattgatatgtcgcatagtggttacgctgtacccgtcccacaaccggacgaacaacccgccggaagtaattttacaaacttccgttttatacgattgtagcaccttttccccgttatccttttcaatgatatgggctttcccgtaaaaggatttttcccggccttgcataactggtagatcataaattttcatatcgtgaacccctttctaaaatgtccgttaagcactgaatatcttttgtgcctttaatatacactgaataaattcagttgtcaataggaaaatacaaaatattttcagtgctttctatacattataaaagagtaaagaaaagtacacttttccagacaaccagccccggctgcaccagatcagccgggaaccagaggccagggcgcaaaagagccgccgacctctcttcctgggagatcggcggcttccacatagtcgcagaggtggcctggatagtcgcagaccttcgagcgggatagtcgcaaagttgtgagccatagtcgtgaaccaggtcactcgtccgtatcatagtcgctggcagtagcttccaaatacttctgttgaagctcttccgagggagtcacctcgccaagctggttgttcggggtcaaaaccacttcctgcttgtcctgatagcccatattgttcttcatcaggaagataccggccacgggattgatcttcccgttctgcatatagttttccatttgagcattcaaattttgatacgccttttttataaggtggcggctttgggcgggaatataggcactatcgacattgttaagccacttccagagggttgttctatccactccaaaagcacaagcgaggccagcaacactcggcttcatatcatcctcaatacaaataccgaaatactgttcaatccgctctgcaacctgttcaggctccctcatatccacttccggccaattccacattcgcatagtatgttgcagatatttacggttgtcacccggttcagtctgcacactcattgccgtagtccgatcaggccgcttgtttccaccagtccccttcggacggccacgccctctcttcggagtcaattcttcactcatattcagcactccttcactaattattttcagttagcctttagtgagtttagtgacccattttcgatttttgctataaatctctctatatatcactctctatggagggtttatacagaaaaatatagaaatagcggtcaaaaatccccttaaagccttgcgccacaagggtttccggtagtggccgattattcaccaaaaaagtcactaaaacgcaccaaaggccaaaagtcgcaaatatattcagtaggccactaaatatattcctctcatgccgggaacaaaactacggttttcgctccatccttttgaagccactcaaaataggcgattttgtctacccggcacccttcttcaaacgggttatcagtattgcaaataaccatttccacagaagcgtcttcggggatattggctaactttgctttcagttctttcacggtcatgcttcttcctcactctcatgctcaggaggggtatcgtcaccctgcatagaagctcgtataaaagcctgggtcaagatcatggcttctccgggagttgcaccggcctgaatggtggctcggtagaagagaatgccggtttcagccagaacgccgattgccttatacagctccttgaacttgtcattgttactcattacggccatctcctttctcgcaccggagagaaatcattttctctctggtcagcttatctactactctcccaatctcaaagtagccggacatagccgccagtcgttccagattttttgcggtctgtgctgtgaccaagatggacatacggcgcatatttttcttattcataaaactcatccttcctgggagtttttcaagtaaaagtcgtagaaagcaactaaatggtcagcagcctctttcatttcctcataggaggcaatgtaggtcttgcacgatgttctatcaagagccgcaataattttacctattttctggaaaaggagaactctctcattttcagtgttcatttcaggaaccggaaagagaaaagccgtttcttttgtgtaaaactccgtaccgtcttcgcatatcactttggttttcttgggtgtaacacgcttaatggtatagggtttatacaaggtcaatcccgtataaacattccacccataggtgatatttctcggaatacacacttgcataccgggtttaagatcattgatgggaataaaaagttcaaactcatttctcttgtaataggccataaaattacactgttcccttcatacgaatgtcccggtaggtaggatagccagagtagacagtcttgcccccatgccattccgggtgaacttccatgtcggcattaaaccgctttgcgctacacacaaaatagccgttggacttacaccaaatcttgtaagcgtcatagagcgtcttagctctggtgtaggcacctccggccttttcacacctttcttctaagaactgcaataccaagtcattgtctttctcatactgcttgactacctgacgcatggccggggacattttcaggccgaaccgcttatatttgaagtagccctccaagagccaagtgaaaatgccacgcatggcctcctgggtctgaaattcacttttgaggtttttgtcctgctcgtcttcggtgaagtgacggttgaactccaccacccgcacacggtcagaggcaaacaggctcttgtcattgacagagggaaggtcgttacaggacagccagagggtgaattgggggaggaaagtcgtggtagcttcgtagaggttccgagccttgatctcttctccaccggtgagctgcttgatagtttcttcgtccagcttgccatactggttgctctccgccatggtcacaaacctcttacctttaagggaagccagcatggggttcgctgcctctgcgttctttgaccggtcagacttgcagataatggacacaggggacacagaagcgtagtcgcccaggagatgatgaatggcactcagcatggtagattttccgttgcgagtggtcttgccgtgaaggatgaacatacactcttcattcgccataccgagcattgaatagcccagggccttttgcagatattcagccttgtccgggtcattgcaagtgacctctgtaataaacctctcccaccgctcacagcgggagtcctgcaaggtatagtcgaaattggtctgcatcgtcaggaagtcccgccaatcatgctcacggaactccatcttctccatgtcgtaggttccgttcaggcagttaatgagaaagggatttgcgtcaaactcttctgccgtaatcggcatgacgctggcagcgtccttcatgagccggtcacggaaacgccggtcgcccatttttacgataaacttcatatactccctgcggcgatcttcgttgtcaatctctccgcagtagagagccataaggcggcaaaattccttgattttctcagccaccaacagggagccaatatccttcctccatgctcccttagaataggtgtaccagcactttgcttctgggcaaaagcgggtatcattctggtagcactcggaaaacagctctgccataccagactcgtcccaggaatagccggtgccgctgatctggtggctccgctccggcttggcctctttgatgtaaaacatctttcgggacaggtctttatccatgatgtaccggccattggagagctgaaaaagttcctgctcttccgtggtcataatttcatcggccatttctcgtcaccttcctcattgcctttgctattaccagcaccgaacaagcctgagcgtcttcatcccaccacgcacacctctcttgacaacaatgcagaacttcgtccgtggaagcattgagagggtaatactgcttattctccatctgttacacccccccccatagaagaaagcgtttctcagggctgtgtcgatatgggacatgatctgaggcgggagggtacagacatatttccagtcttcggtaatgtcgatgacccgtacctgttcacactcgaccatgctttgctccaagttctcccacacaaaagcaacatgagtgggcatttccagccgcttcatctttgtggtcagagggactacaatgctggtgggagagaactggttccccatgttattttgaacgatgacccagggccgcttgcctccctgcacatggccggaggctgggataggtacatctataatgacaacatctccacgctgataaggtttcataaattacctcctatatctggtaactgaatttacaatggtttcaatctccgaacggggaagaggcggcttgcaagcctgagtgttggcatacagcagctctttgtaaatctccgctttggaatatccctgattgtgcatctgaccggccagagaagtcagactcaggttccggctcccggtagtgattgcgggatattctggttttagagagattttccccggctctggctttcggtagattggggaataaatgcgttgtggagcggaggaaccggcaccttctttcggaacatcaggaaaatacttggaaacgatataatcaatcgcttcttgattttcaatgatttccgaataaataatgacttttccggtcataatgaagtaccgtccactccgataaatctccaccccggctcggttgttacgacctttgaaggggagagagcctttcagcagaatgtgtacccctcttccgctgcggctcttctccgtataagaaccgcaatggctgataatgtcagaggccaacgggttcaatagtccttctgaaaaaccgtcatcaatgtcaatcccgattagtccatcgtcattgaacacatatccgatgccgtcatagatgccgttcgccacattcagcacagcacaatcaaaagttccccaggtatcgggcagcacagaagaggcagcttttttctggccggtctgcatgggaaccttgctgctattccagacattgacccattgggtcttttctttcaattcagagggtattttttcatacatgacggcacctcttggtcattcaggtttcataaggggaagggagcgaccaatcccatgtttctccgcctttgtaggcatttctaaaataattgtgtttgccatctccgctgaaccagagatagtcagaaggtagaacccgccccgtattggtttccccatctttttccgcataccatcgggtaagaacatcttcacacagggctttaatttcatcatcaatcgggttatctgcaccatacccgatgaattgataaggagcggtaactaccgtagtgatcgaaccatatccctgatcgacacggttgagcgcacaccacacacaagcggccttttccgtatcagacggtacgcccctggcctctccccataccatctttgccagcacatcaacctcttcctcgctccaaagaggaacagtgggtgtgggttccggtgtagtgacttcaagcacaggaagttcaggaggttcaatgatttctgtttccggcttggcggaacaggaagataggagaaccaatgacagcagcagtaccggaagcagcttactcattagtggttttccttttctttggagaggtcttggtggcgaagaaatacttgttatccacacagaccggatagccgggaaacctattgctggctctcttggttccctcgctgtaaatcttttccgcagtttcaagcggcatttcgccggtaacatgatctgcaccggcgaccatgatatacgggactttcccgttattgttcacgaatgtcatgaatacttcccctttctctgttccatgcctccacatcgacaccaatctttttcagttcttctttgcagagccatgtgtaatcgtccggcatttcgtaatgttgaataagccggtcatgctctgcggcaaaggcttcataaaagcgtctgagccgcttagggccgaagcccaggtgaaccgcaagggtatagagaaccattgcgtcaatgtcatcggtatagcgtttatccgcttcgatgatttgccggttgatctccatttccatggcctttttctctgcggcggtgaagactgctccgtaaacctttcctccggcctttttcacaatcatggtttacacctcgaagtcttcaaagaaagccgggtatcgggtctgcatctcagccaggagcatctttgcgacctctcgcatatccgggtgtgcggcaggagcggtacggagccgaaggaagtgcctccactcccgcatattggccgtcatgaccacctcagtcttcgtgctgttaggaagaacagatcgggcctcctgcggagtacagccgtagtcgagcatggcgaaataagaaaattctgcctgtttgcaagccgcaatccactgaggcattgccacgctcccttttgccatagtagagggccggacgaaggaaatctctccgccaaaactctcttttgagtagttgcaatagcgggtactttcctggcagtaggaggccagtcggtgccggacaatctcatggctcacgcctctatcacaggtaaagcgaacactcacgctgccatgttcgatgacagcttcatgacctcgcttcaagatgttcctgacaaacttttctgcgctgtccccggtaatcttgctctcggacttatagcaagtgcgtccggccagctcaatcagagagagaaggtcagaataggcaggaggattgataagctccactttaggttcaatgatcttcatgctcaaactccttccacatggcttgccaacatatccgcttggtgcgcccacaacacattaggatagaggttgacggctctggtgtaatcgttccactcggacttgtcggtaaaggctcccatgtgatacctgatacacagaacctcttcctccgtcagcttgtagaactggcttaggagcatgaccgatttatcgccgtggcctttgagaagcgtgttaggattatgctcccaagagagttcatcgaaaatggactgcttctccccgccgatgtaaattgtgtctttgacaggatgacggtacaggtcgattttgcagaggtcatggaagatacccaccagatagggagaacggcagtccttccatttcaattccaatctctcagtcaggccgaccaagtgttttgctacggacagagagtggtcaaacaagccgccctcatagttaccgtggtacttagtcgaagcgggagcggtgaaaaagccattgatggtgagatagtccaaaacctcaaccgtagccagaggggttccgtccggcagacgcatgaagtttaggaactcagaccggcgatctctttcggtcatgacccagcaccttcttcctgatctaatctgtcggaaagccgattaactttctgtttttgccagtttctcacttcacaagaacatttgaaaatacacttaatttgagccagcataatttccacatcagcgatttcttctgcgatatgcttcacatcggtttgccctctaaggtgtttgcagagttccttttgcaattcagacatttcctcgaaaagcatattgatttgactgtttacgccgtaatgttcaacggctctgctgataactgaatactcactcagcgtcatggtcggaaacctccatttccagcaccgtcataatggcataattggcaaggtcaatcagggtgtcccgaatggactcgtcatttaccttctgttcctcgttccgagaaagagtcttaaaccggttaaacttatcgcccaacctgatacgggccattgccataccctcttcaacaaaggtctggtggaagctatcaccgtaatcatggttcttccgggcatagagatcgttgatttcctcacagatttcccggtgcatttgaacctttgtctttgttgtggtcaaagtatcttatcctcactttccacatatttttcaacaaaccattggcgagggagagcggaaatttagccgccctccctcgtccataatcagccaagaagggccatcaggtcactcttagatttaggggccgcaggagccgcctgagcggacgcaggagcggttttgggagcctgggtgggtgagggtgccgcctgttcatcccacccgtcagagggccgcttatcggccaaccgagcgaaggtaatggtcttgtccggcttgttcttgttcggctgaacatcatgctcaatatcgcactcgatgaagtgacctacaaggtcttcatggtcgatttcggtaagctcgaaatcctgcaaggcggtcttcgcaaaatagctgaacgcattaagcgcaccttcgttcggagagccgtcagttttcagcagggaaaaccgctcaatgtgcttggctccgctttgcgtctgcatggtaatttccagcttgccaaaggcttccttatagctgaccccggtaattttgaagacatgggttccttccgggataagggaaaacccatcactcaaaccaattttagccatcttgtttgtcctccttagacttcatcattgacgggaaagatgatgcccacaagttcctcgtcatctccgggtaattccgggaaactctttaccagcagggcttttgcgacattggaattggtgtcaatgtcgtaggcataaaggatttcacaggtgtctttccgctcaatcagcttccagtcatcgttgctgatcttgatagaaatgtcaccggcctgggtcttatagacccgaatacaatccttgatgccgccatcgggatagggcatgattgcctcagacagaaccgcataatctgtatgaccaatctggtcaatcatcttgtcaatggcctggggcatatcctgaatagccgcagcggtcacgcttttcaccgtagtgggaatgagcatcatagccgtgggggaggccagccagcggtcagcaaagggcaggtcttcaatccctctcttatagatcactccgctggaagccagagatttcacaaaattcttaaacttcatcggtcatccctccttaatcgctttcggcagcaaccggtagctgtcctcggtggtactgtacttatccaaaaccccgtccgctttcatagcgtccttattgattttggtagtggtactcttgctaacttcccaggtataggcagtaccggcgatagacacctttttgtccccctcacgaaactgctggatagccgcctttttaatcatatcggtcagagtgttgtaccgtttctcgtcatcggaaacctcggcggcatgagcgtccagcttacctttcagctcttcggcttctttcaccagagcctccaagtcggtttcaggagagaaattgttggtacggagagcggccagtatttcagcgtcctttttctcgtcatagaccggagagaggccgctttccacatggtctttccaccacttcaaagccggtttcacataccgtttctcgaagtccgggtaacgctcagacaccttgaaaggccgggtgattgtgttgctggaactgcacacgaagttctcagggtgttcataatcaccgggttccaggaaggaggccaccatgattacgctgtctacgcccaggagatacgcatagagggcagcttggagggcataatattcaggaatatcttccgcccaatcctctacacgcttggaggtcttcatttccagaacagttgtaggcttgccatcttttccatgcagcaggtagtcccacataccaccgagtaccggcgtatcagagaagaaatcaccgaaggtcttctggaaataattctcgccgtaaatatcggttggagtgaccagattgctcatgaagtaggtgttcttcatgtactctgcctgtttcggctcgatggtcttaccggcaacggtgtaaatcgtgtcctcgaagggcttctggtaggtacgggtgatctcacaccagacctcaaagggagtagaccaaggattgaggccgagaatggtagcgaaccgggtagcggtcagcttcttaggacgcttgggcggcacaatctgaattttgttgtcaatccattccatgattaaccctcctgagtgtcatacgccgagagcatatcccgtacaccggtaatgagctggtcgcacacatcagcggtgatcttggtgaagccctcagtctttacggccacattctgcacaaagctctcctgctctgcgtccagctccatgagctttttcagttccgctttcagcgtggcaacctgttcctcactggcggcaccctccggggcggaagtcaactcggacttgatttcctgacgcttctcagcggtcacaggagccttttttgcggtcttagggggagagggaggtgtctgagtatcttcatcggcaccggaggtattgtcgatactgtcagcctcgataatgtcaagaacgagctgccacagataccggcgcatataggtaatagaactgcccagggcttgcatttcgttcgtcacaaccttgccgctgttggagatgatgggggcgatctgcgtgaagggagcctcaaaggtaataggctcttcatcccggtcatcacagttgaagactttggcaatggcgtactccttgccgaaggtaggagccatcagtagacccacttccgtgaaaatggactcggccacaggaacaatgtcactcagctcgaagtacatgaactccaagtgaatgtttttgccggttttcttcacaccggcttgcaggaacttcaatcgggcaatctgcaacttccggcagatattcatgccgctgtaatcaacggcgggtgcgggggtctttttactctcggtagccatttttcttatacctcctgaaacttcttcaaaaacttgtgagaactgatatactcattgatcttcgctctctgcttacctgcggccctacggcggttgaaaaacaaccgtctgcgctctgctctaccaggatttttcttcatactgaaccctccaataatttcaatagatttcttttcgtgacagcgataagattatcgccggtcaacatcttccatcggaatttgcggtctgtcggcacaagcccaaggtcttctgcttgaaaccgaagatcatagtcacgcaccgtatggccgtctgccttgaatgtgaccggactatccctatcccatttcaaaagcaatttccagaggtcagggtaggtttttcgcaataatcggagctggtctattccttgattgtgacagaaccaacacccccccccttgttgcggttgtgtaaatcggggagagcaagtcccgctcttcacaccacttccggcagtaggcttcatcccacccgacttccaccaggggcattaggaacccaggcttgttgtgacgcacaatgcgctcaggctcgtcagcagcaattccaaggtactgcacaatatttgtcttcgctccttgtgcaagggagcttcttgaaaaggcaccgtttgagatcgctggtacaccaattccccttgatgatagggaagccgaggataagacccgtctttgagtttcttgcaccaactgctgattgtataggggaagccacatggaatgttcggttttgagatgtttgcaccaactgccgattgtgagcggccatcctttcgctctcccccccccaatctccatttgttcgtttggcttcttttctcttcggaacatgatagaacagcttctcgtaggtcagcttttcaccatttcgagtagcacaaaggtgttccacctcaatgccccaccgctccttgatgatcttatcggccttagctttgaactcaaccataggagggaggtcagcttgaatggtatcagtagcccatacctcagcgtgaataatacgatcaagcggccaaccaagttcttcaatggctcccaagcaagctaaactgtccttaccataggagagtgaaaggacatactctgtgttcggttctctttccaagactatccctccaacaaagccgtcagctctcgtttgaccttatttactctccgggtattccgcttagggggcttgataccaaggaaatcccggacataccgttttgccagccggatataccagtcacggtcaaccacctcaatagagagatgattgtcattgtctaccacgcatcttgacggcaatccggcaatcttcacggggtttccagtcgagaggtgcattttgtaaagcgttcccatacggtgatcgtccgtggcatagacccggttgactttctgtaccacttgtaattctccatccacctcatgaagagcgtcaccatacttactcccagccttggcgatcagttggaagtccagcagcttattacactccatgatagtctgctccacaggaactccgtaggccagacaatccttgaccgctctggcaactacacaggcattgttattgacattgaacgctcctgccggtgcaatccctcgaaccagaaccccgcctttgattttggggtcgccctcaaacgggacttccacataattgtttacatctttctggcagatcatctttatcaggtcttcttccaactcaaagccggtgcgttgctcccattctccggtaatctcttgatacttgggaacatcggagtcatcaaggctgaccatgataccatcggtgttgagctgaatgattttcagcgtagggcaatcctgaatgagatggatagccatttcaagaagctgtaactgtcctgagatacagaccgagcggcccatgagggggtcatagaggtcgttatacttgttcaacatggctccataggtggtgttcagcaccagctttagagcattggccgtggccttgtcaccagcctttttcgctttgacccgccgctcaatggtagctgcatacacatcgggagagggaatgttccgactgcaatagccgtttaagatcatctggtgaggataatagctggcaacatctttattgcggatggaacgggttttcgtagcttcctcccggtaacagggaatggccccatgaatacctccgtaggcaatcgtgcaagggcagtcaccaaccatgatttccagcttctctttgaacaccacctcattggggatggtcatgtctttcagccggtcaaaaaatgcaaatacctcctgcggaatgtactggcgtaacagagtagccgggtactgatattcccgctcgtcataatggggtttaggctctgcgtcaaggtaggtagcagtcagcttggcattggtcatatagagggcctttgccgggtaaatgcctttctctttgcccagggtcaatttgctggacaggtagccctgtcgaaggtcatccaacttatcggttgcgtccacatcatgcttgcagtagaagatgacctcttccagctcttcgggagtcaatggtctatcaagattgaaagatacagtagtttcccgaatatccatacccaggtgagcttctattgctttcagggacaatcccatctggcaatcgtccatgaggtcgtattggtcaaagtatatccggctctctcgaagatcagggtgttcccatccctcatgcccctggacgatgatgaaatcattgaccactttcacctcttccggcgtatagtctgccaaaacagctttcagaatgaattggtcatagtgcttgttattgaacccggccaaaagtggctcctgttccatgaactgtttgactgcttcgttgtcgttgtgaattacggtgtactctccggtggccttgtgtttgaacacgaaaagccaatcaaaggcaaacacctcacagtcaaagataaaaagattatccactcatatcgcctccccactgttgggccattgcttgtgcaacacccagaaatgtttttgaacgagtttttgggtcacgctcattcctaccctgaaatcttcggtaattcccatgagcgtctttacaacctccattaacatacggggtaactccttcccgaataatatcggtaggggtaaggggggggggaggtttttaagccacaggcaagtccgcttcgtgtaagggtgtccgaaccaccacggctgtatcgcttgggtatattgcggcaactggtgaatttttccgggtgtggggttctcaacacaaattttctggcaatctgcttccagaaacttcatgaaaaacgctttggcttcaacggctttcgccattcgttctttattgatttccccttttattcgcaatcggacagaacctgcattggtcaggtaggtgcatggaggaaaagcaatcagcaaatcccatgttccaacaatggcgtgaagatcaccgtccatcgtaataaacggcttattgccattgataagaggaagaacatctcctttgatgtgccattccgggtgcccaccagaacactcttgtgtatcgcaagaataggcttcatgccccaatttccgaaaggcgatacataccgcttgactctcttcacaggctacaaggactttcattttaccttggctccccggatgatatagatacacttatcaactcggtaagcatcataccccttcgggtgctgctcattgtacttgcgcttatgacccgaaatggttgccagtttgttcttcgcctcttccttggtgtcatactcaaagcacatattctttgcgttaccgctggttagaaaatcttcaatggccttgacttcttcgctcttggcaaatccccttctgtcgggagcctgaacattgtaggtaattttcaatctattcaccctcttcttaattggtttccggggcagctatcgtgtcgatataacagaggtcttctgtacccggtataacatcaaacagactgaccgtaattggctcagaggcttgttttcgcctttcatgccctacggcagagcgcattgcggaacaggctaccgtgataaacttcaatttctgcaactcaggaagtgcaaaatatcgcttcacacttaacagataccggaagataaccacatcaaaccattcatcggagtttaagccctgttgtcttaaatagcggtacacaatactaatgtgttccgaagcaaaccggctttcttcaagtgtgagaggccgttcataaaactgtttcgggagcctgactgctccacccacatcacactcacgggttttcatttgtccccccccctcattctaaaattttgcaaccgcatttgcggtacgaagtgcatcgttttttataactgcggacaaggtattgaataccgttatccacataatcataggcaatcggttctcccttgccctcaaaggttctggcaatacgacctacgctctgtgtaataatagcgtaatccttttgcggagtggtgaggtataaccggtcaagcctgggaatgtccaacccctcttttgccagggcataggttgcgaacaaatagtgtttcttcccggctctcatgtcctctatggcctgttcccgtttcgccttgccctttttggaagtcattttcccgtctaccattaccgcttgatctctcaaatgtttcgggagatgggccatcaaatattccaggtgggccaaccggtcagacaaaacaaggttgtaatgctcggcgttcagcatgagatcaccgacaatctgaccgtttctacggaagtcctcagccagataatttatcagcttggcatagatgatcgtgccgtccgtatcaaggaactctttacttagaccaatttgggtaggccggggaaggacactgacggtcatgattttatcggctaccgcttcgtctggcacctgataggcgatttttcccaaaagagcgtaagtagcagcaatcatgccgtctgcccgatgaaccgtagcagagaggccgtacttatgccgagcggccagtgagcttagtaccttggaaaattgtgtgactgcggtaggtgtaccggctacccggtggcactcgtccacaatgacacaaccccaagtgtccctgtatcggcttagatcaagattgcacatggtctgtaccgttgcgaaggtgatacccctaccaatctggactcttccctctgtgattgttccggtcagggccgaactcatatactgctccgctcggctcttgctctgcaaaagcaagtccctcgtatgggtgagccagagtgccttttctccaatctcgcaagccagcgcaattccgatctgcgttttaccggagccagccgcactctgcaaaatcccacgaccactttctaccagagcgtcctttgctttttcctgataatcgtaaaggggaatgttgcactggaagtcaaccttggactgcggagcaaaggtcatggacacatcggtgaatggagccagccgaagaacatcattgaagcaaccgtagggaagcaccagcgtgtcgccatcccattgcatgagatacaacttctgcggtgtattaccaagccataggttcatacgggcttttttggtataatcgggatttgccaacaccagatttttcttgcaccactccaacaggtcagcggtagggttctcaatcctgagctgattagaaacggtcatccgcatttcgacacccactcttccagtgtaattccgaactgcttaatttctgaccagtacaacgatctccgggtaagcatggccctctccatagtttcaagagagataaaccatacctctccgtttgtcattctgagagcaaaccatccttcaccgtttcccgtctgtcgccagagtgtcattgcggaatactgattttcttccactcgttccagtcggaaaacatctttctcacataccttgcagtcaatgggataggtgtggccattcttagcggcaatcacatcaaatggctggccttggctgttttgcgccatctggtgcgcccaaaagccataccctgcgaggctggtacaaagctgccgctcaaaagaggttccagtcttacggttcatgtttgtcaaaccacattccctccccacatatctctcaggagtgcggatgccttaacgcaataacgagcggcgttcaagtgagtagtagaacttcggctcaagtctaaagccttatcacggaaccgcatatattcctggtattcttcggatttgcgagaacatcttgccttaatgacctctgcctcccgcataagtccctgagccatgcttcgagcatcttccgccattttgacttccaggactttgcgctccttgaaataatccaaaagctctcttactttttcgtcatcccaatcagtgtcagcaaccaagagcttgaagagcttcctggttttctccatcgtggttgggaaaaattcatcagcaagtaactcgcagcctccgctataccatgaaattttcacaatatagttcatgactctcctttccccgccccttacggggcgggatttcgcagatattggattaaacgcagaagccgaaggacacgccagtagaggtgttggcggcgttatcgccggcgtctcccgaactgctcacaatgcaaaaatagctggcgttgccgctacgaggcgaacgctcccaacgccaatcccgctcaccgttctgcttgcactttccgtactcggtgttctcctggcgataccagccataccaatgcccctcgtcaccgtgggaataaatctttcggccaaaaatttcctgctcggacagaacaaacagagggtcagaagtcaggccgtacttctcgctgtttccgcccaaactcgtcttcttcaaacagggcttgatgaccttccgaagatcagcaggaagcatttcgatgacggaattattcagaaccttgcggagttgggaattttgccagccgcccttgttggtgtactcagggttcatctgaaagtcatcattgagggtttctaccgtttcaaaggtgatgggcaggatattattctctttatccgtatcgtgattgaagtcgatgatacgggccgacataactgtgccattagacagggtgaattttttggtatcgccttgagcaaacaccttatcagccatgccagactgagcatacatagcgatttcagcccaagagcaatcgtccagtttcatcttcgggagttcgggaagggtgtaaatccggccatctgcgggaaccttgcaacaggggcaagtaggggtcttctgcatggtggaaatgacttccttttggtaggtgatcgtccgctccaagcggtcaaactcagccgcaagctgagaaaatacattcttatccatgtgaaaatctccttttcaattttcaaaatgtctggtataatcagattgagcttttacgcttgccgtggatgggactgcactcccgtctgcggcttttccttttctgcgtaggataaaacgctccggccagtttacaaaagacatagaagaggaatagggcaaaggccatgtgaagcgttccggtgccaagagtcatcatgtcttgctcaacagcggcaaccgttccaaggagccagaaaaaggagagaaatgccagggttccaaatatccgtttcattcatctgtaaccttcttccacacatactcttctccggtcttctttctgtaccagtcctcaaactcggccctgtgtacggggtcagtgaaatattcccgcacaatttgaagcaacaacaggcttgcggctttagcctgggcttgaacttccggtacaaaggcactcacggctccccgcatgaccccatccgcatctgataccgatgtagaatatcaagggagcggcgaaggatttcgtctgctttgtccccggtgcgaacaccagagagcgttgcggacatttcgtacttatcagtcatcagtccttcatcagagagctgccggataagccaagtaaaagtcagacttgcaccggccacaagttccctgatctgctcacggtagctcgtgcgctcctgctccgtcagccggataacaggtacatcgggtgtccaatacggacggggtgtagggtttcccaccatcatgcgacctcctttcttcgatttacaactaaagttataaataatccttgtcaactaaaatcgcttatgctatactggacttgtcacagaacaataagcattagagatttcatttttgcataggagccgaatttctttcaaagaaagagatttgacccctcggattgttgttgcctgttttataactttcgttgttgatatgagtatatcaacgattatcgttgttgtcaatagggtatcaacaatttctgttgatttattttcaggaggtgcccgcacaatgaaaacggtaaatcgtactcccgaagagcaagctattctcgataacattgttgcctgtctaaattacaagaaaattgaacaaaaggatttatgtgaatatcttggttttagttctcagatgttcacaaactggaaaaacaaatcaagtaattcttatctgaaacggcttactaaaattgcagaatttcttgatatttcagtcgatcatcttttaggaaaggtcagtatttccggcgcgtcagagttagaagaacggctactcagatacttttctttttgtgacgcagagggtaaattgcgtattattcaatgcgccatgaatgaatttgaccgaacagcaaaagaaaaaacagacccttcggaagagcctgttgttggctaaggtcatcgacctgtctgaatggagaaagacgctatgaaaatcacaaaattccctattgacctctccatgttgaccgaagaggaaatagaccagttcagacaagacccctccacactttttgaaggggacaccgatgtatcgttgtaccttcggttcagctccgagcggcaacgggaacaatccattgaagggcagctccgtgattgccgaaccttctgcaaactgaatagctaccgtattacagccatctatgtagaccgggccaccaccgccagaaaagatgtagagaagcgggttcacttccaagaaatgatacgggacagcgagaaaaagccctgggagtatgtggttgtttggaaacttgaccgctttgctcggaaccgaacagacagcgcacttttcaaattccgcctcagaaagaacggcgtaaaggtcatctctgctactgagaacatttctgagaaaccggagggtattattcttgaagctgtgttggaaggtatggcggaattttactctgccgacctctcgcagaagatcaccagaggtatgagggagtctgccttgaaatgccatagtataggaggtcatatccccctcggctataagattgaagatcacaagctggttatcaatccggctaccgctcatatcgtccaagaggcttttgaactttatgccaatggggaaaccgtagccgatatttgccgtatgtttaatgcaaaaggctatcgcacagccaagggagtagagtttaaccggaatagtttcaagtccatgttccgtaataaacgatatatcggggtctatacctacaaagatattgagatggaaggaggcgttccggccatcattgacaaggaactgtttgaaacggtgagccgtaggctctctaagaacgcagaagccccggcaaggggcaaagccaaggtggattacctcttggccggaaagctcttctgcggccattgtggaggctctatgaatggggaaagcggaaccagcagaaccggagctgtccacaattactacacctgttataccaggaagcggaaacacgcttgtgaaaagaagcccttgaagaaagaatggatagagtatatcgtagcgcaagacgctatggagttactgaccgatgataccattcaagaactggcagatatggcgatctctcaaactgaaaaggacttgcgagaaaatacccgtattcctgaacttacagagcggatgaaggaaacagagagcggtattaccaatattacaaacgccattgaaaagggtatcgcctctgacgctcttatgaaccgacttgtagagttggagaaagaaaagaaaaatcttctccgacttttagccgaagaagagaaatatgtctgtaaaattgagcggagccagattgtctactggctgaccgagtttaagggaggccgcatcgaagacgagagataccggcgcattatcattgaccttatggtgaactccgttactgtatgggatgaacctgacggtttccgcattacgacagcatataacttgacctcttgcaagagtaagactttccgcatagacccttccggcgagaaggggttcggatttgaggggtcaaagtccaccagaaaagaaagacacgacgaaagtcgtgtctttctttttgtgttcaatccgctgatgtgggtaccagtaattatgacacaccccggataccatgttctgggacagaaactttaaagggtattattatgtacaattttgaatcaattttatctctgggggtattttggtatacagcaaaagatttggactataccaaaaaataaatatggtacttttgcttgaggaaagatactgatataattctcacaaattgttagacatacttggagagtgcacaagacacttttcacaaaagagaggggctgggcggcaggtgggagaaggatgaacatcaggatcaatcgcagcagccagacccccatctatctccaaataaaatgcgccattcagaatttgattttatcgggggagctcagccctggctacaagatgccggcagagcgaaagctggccggagagctggatatacatcggaataccgtcatcaaggcatatggagagctggttgacgagggatatctgatcgtctcctcgaagcggccgaagggttactttgtcaaggagattgccgacgacggagtgccattcaagcgctttttcccgctggagaaaatgattcgctatcattttacggacaaggagaagctgtttctggacatcttcagccggtcggagcgggaggaatgcatctcgatgggcgggatcatcatggatgatgcggcttatcccagagagggcgtagagaagattctgcagaacatgtcccgggagccgcgaaacgaggccgaacggatgaagaaaaacatctgttctgtactttttcaggagaacatgtacgtcagcccaaagaatattcagttggttgccgagaccaatcaggcactgagccatatcatgacactctatctggaagagggggactacgtgatagcagaggagccggtggtacccgacaacgccagcattttccgcaacaaggggatcaacctcgtaacagtgccgatggagccggacgggatggatctggccaagttggagacagcgatccgaaaatacgcaccgaaattcatctataccatgccaaactatcacaatcctacgggcattgtgatgtccctggagaaacggaaaaagctgctggagctggcgggaaggtattgtattcccatcatcgaagaggactcccagcgggattttcgatacgaaggaaaccggcttcccagcctgtacgctcaggatcggtaccggtcggtgatctatatcgactccttcacgctgacctttccttatgggattaagacggggtatattgtggggcctaccgacctgatcgaaacgctggaacggctcattgttgtggacgagacctttgtaagcagcctagggcaatatattcttaatgagtatatcgagcgcggatattatcaaacccatatcggacacttggtgaagcactatgcgcacaagcgggatctcctttgccaatgtctggacgggattgcggacaaggggattacctataccaagccccggggtgggctgcttctctggtgtgatctcgaagaacgcatcaatgaacgcaggctgtatcacgaggcggagagccgcgggctgttaattatgcccggcttcctgttttacccgaagggctatgagggcggcggtcatgttcggctgtgcttttccaatatcagcgatgccgacattgaacgaggtgtccaaattttgagtgaagcgctggaacacagcgtggaataaacctgtggagggatagcatgaaccagttaacagagtaccggagagagttccataaatacccagaaaacggctggcgggaatttcgaaccagcgcccgggtggccgagatactgaccgggatggggtatgatgtggccatgggaccggacgtgatcgagcccggaagcgtgggggagcctgagcggctgagcgaggagcagatccgtcaggagatggagcgagccgtccggcagggagccgatccggcatttgtgaagcggacccagggctggcccggcgtgatggcggtgctggacaccggaagggaggggcctgtctccgcgatgcggtttgagatggactgcctgccctacgacgaacctcagaggccgggataccgcccctgtgacgagggctatctctcctgcaacccccagtcagtacacgcctgcggccatgacggacacacggctatcggcttgggcatcgccgcagagctgatgaaacggaagggggagctgaagggaaagatcaagctcttcttccagcctgccgaggagacgttctatggcgcccagtccatcgtggataaggggcacctggacgacgtgatgaactttatcgcggtacatatcgccctgagcgcggagaacaagcctctgccctcccataccgtagcctgcgggtgccgggatttcctcagcgaccggcagttggatgtctatctggagggaaaggccgcccacccctgcggggcctcccaagagggaaagaacgccctgctggccgcctgctccgccgcattaaacatccacagcatcgccccccacgaggagggcctgtgccgggtgaatgtgggcgagatccacgccggtgtgtgtgccaataccattgcgccggacgccatgatgcgcattgagtaccgggggcagaagcccgcgatctccgaatacgcgggccagcggatcttcgatattctggagggcactgcaaaggcctacgacctcaagtatcactatgtggattacggagaggtgcccgcaggcgccagcgactatgccatgatggaggttgtccagcgggcggcccaaaaggtgccctggttccagacagtatattttgagggcaatgtcggcggtacggatgacgccgccgtaatgttgaccaaggtacagcagaacggaggaattggctcctatgtgggcattggtgcggataccaccggccccgttcacaaccccgaatttgactttgacgaggactgtctgcaggccgccatggagctgtgtgtgtatgccctggaggagctccatgggatggatgcttgacttagaaagaagaggacagtgtaaaaacattaggaggtaaagagaacgatggctgagaaagttgtatccaagttgagggggaacatgtggcggctgatcattctggcagtggccggctccctgatctacggactgccttatttcaggacctattactatgacgcgtatctccaggcgtataacctgaccaacacccagatgggctcgctgggctccatctttggcgtattcggcatgatttcctatctgttcggcggtgtcgtagccgactttatctctcccaagaagctgatctccatctcactgatcctgaccggggtggctggattctgccacctgttcgcgaccaactattccatgctcctggtgatttacctggtgtggggttttacagcgctctttgcgttctggcccgcattggtcaagggtattcgtagtctggcctcctctgaggagcagggaaaggcctacggcttcatggaggctggacgcggcgtgaccaacgcggcccatctcgctatcgctctggccatcatcaccgccatcaccagcaagcgtggcagcgccgccggcctcaagggaggcatcatcttctactctgtcgttgtgattgtgctgggcatcctagtgctcctcttctttaaggatcctgagacctctgacaagtccgagcgcttcaacttcaagcaggttctgaccgtgatgaagctgccccaggtgtggatcctctgcctgatcctgtgctgcacctatgtcatgaacatgtcctatgcctacttcaacccctacgccacctctactctgggcgtggccatggtgggcggcaccattgtaacgattatggcggactacatccgtccctttgcctctgtgggcggcggcgtcctggcagaccgtctgggccggcccaggatcatgaccatcgcctttgccatcatggcggttggtacgtttgccatcgccctgttccccaagatgagcgtgcccgtctttgtggccctgtgcgccctggtgtatgtgggtatgtactgcaactacggcatcgtgttctccctgatggatgacggcggtattcccatggaggtttccggcaccgctgtgggcgtgatctgcaccatcggctatctgcccgaggtggtctgccccgcgactgccggtatcatcctggatacatttaccgaagcgggctataagtattacttccttgccgtcggtatcattatgctcatcggtattgtgggtattatgatctggaaccgcagcatgaaaaagcagaaagcactgaacaagtaaacaaaagagctggtatccattccggataccagctctattttatttgtacgtttccagtgcggcatctgaggggaaacggagccggagaaggcagacggcaaacagcaggccgcccaggaaccaggtcagcggataggcccagtagatcacccgaatatcgggaatgaaatgggtgacggcggtgatgtaggcgatgcgcagggcgcaccaggtggccagcatgatagccatggggatgattggccgcccggtcccccggagaatgcctgcacagcagtgggagaaggccaggaggaagtagaacaggctgacggtccgggcgtcggccacgccgtaggcgatgacctccgggctgctgttgaaggcggcaaccagcaggggagagaggacgaagatgcccagcccgatggcctcggccagcaggggactgcacagcagcccgaaccggatgccggagcggacccggtcatagcgccgcgccccgatgttctggcttacaaaggtggccagggccatggaaaagcaggagaccggcaaaaaggcaaagccctcgattttgctgtaggcaccgcagcccgccatggccgccgagccgaaggcgttgatgttggcctggacgatgacgttggccagggagatgaccgagttctgaacgccggagggaatacccagatagacgacctgccgaagcatatcgccgtgaaagcgtacctgccgccaggacaggcggtagctgtgcccggtgtgggtgagcttgcggaaagccaggagggcgctgagggtctggctgaggatggtggccagagccgcgctggccacgccccagcggaagacggccacgaacaacagatccaataccacgttggtgagggaggcgaaaatcagatacttcatgggactgcggctgtcccccacagactggaggatgctggcgcacatattgtagagcactacggcgctggagcctagaaagtacactcgaaaatacgcaatggaatttccgatgacatcgccgggtgtgcccatccagcgcagaatctggggggtcagcagaacgcccaccacggtgagcacaagcccggccgcgatgcccagcgctacggtggtgtggagggcgcgggagagattttcccggtcatcggcgccgtaaaagcgggcaataaccaccccggcacccagggagactccgttaataaaccctaccagcagcataatcatgctggcggaggagcccaccgccgccagagcggtgctgccgatgaaattgccaacaatcagggagtctacggcgttgtagagctgctgaaacaggttactgaggaaaataggcagggcgaaggccagcatcttccggggcacactgccttcggtcagacggttctggtcggtttcatccatgcggtacgatcacggctttctgtttgatagagtacagcccggcgctccgccggcggccgcctgcactacagggaaatgtccgcggactttgcggcggcatcgagcacgtggcgggccagcacggaggtggtcacggcccccacgcctccggggacgggggtaacggcacccaccacggcttcggccgcagcgaaatccacgtcacccaccaaatggccggcggcgtccacattgatacccacgtcgatgaccacttggccgggggagaggcagttggcaccgataatcccggcccttccagcggcggcgatcagcagctctgcccgacggcattcggccgccaaatcggcggtgcgggtgtggcagagggtgacggtggcgttccggttcagcagcagcatagctgccggccttccgataaccagactgcgccccaccaccacggcgcgcctgccggtaggctcaaagccatagtagtccagcagttccaggcaggcctgagcggtgcaggggggataaccctgcccgtcaccggagaatacactggccagggaaccgctggtgatgccatccacatccttgacgggggagagggcggcacacaccgccgcctcgtccaagtgtctgggcagaggacggaaaaggaggcagccgtgaatggccccgtcctcgttgatccggcggatgaccgtcagcagttcctcctgggtgcaattgactggcaggataaaatgctttacagaaattccgatcatttcacagcgcttgcaggccccacgctcgtaggagagatcctccgaccgctctcccacccggacgatggccagggtgggagaaatgccgcgggcccgcagcctctccgcctgtccgcacaggcgttcggtgagcgcggcggccactggcgcccccttccaaagctctgccatcaggtgtacctccccatcaccgactcatagatctgttcggcgcgcttccagtactgctccacaaggccgtcagcttcgtcattcatggcctccgcatacggccggtcggccatgctcttggtattcaccttcacgttgagccatgccccatagagggcaccccagcatagaacagccccggttcccacatcggagagcaccatcacgcttcccttgtccagcatctcactgtgaaggtcaattgcctcacagcaaagccggaggatctccatgggtgcggcggcggcgtctcgcagacaacgctccatcacctcaccccggctcgggtcctccttcgggatggcgtaggcccgcgagaggggctcaaatgcggcggcgtcggtatccaccaggcccagcaaacgggcacggaggtcctccgcccgcgccatcagggccttgacatcctcctccactgcggcgtatttttgcttgcccacggtgtagttgccaaccatggtacacagggccgcgcccagggcgcccgccaaggcggaagcccctccgccgccggggacgggggccttggaggccagtgcgtccagaaacgcgccgcagctctgttccgcggtattcattcgcaatccctccttcatgattcagataggtggcctacggccgcctatctgccgtttcaatgggctcaaaacaggccggagattctgccgttctcgtctacgtccaccttttcggccgcgggcactttgggcaggccgggcatggtcatgatgtcgccggtgagggcgaccaggaacccggcgccggcggaccccttaatattgcgtaccgtgatggtgaagcccctgggcgcgcccagaagggcggcgttatcagagaaggagtactgagtcttggccatgcagatgggcagggagccaaagcccagctcagtgagctccgccgcctgcttttgggcggtgggggtgagcaccacgccgtcgccgtgatagaccttcgttacgatagcggccagcttgtcctcaatggaggcgtccagctcgtaggagaaggtgaagtggttgggcgcatcgcagaggcggatgacctcctcggccagggcaacgccaccctcgccgcccttggcccacacctcggagagggctacgttcacccccagtgcgcggcagcggttctccaccagctccagctccgcctcggtgtcggtggggaaacggttaacggccaccacacagggcaggccgtagacctcggtgatatttgccacgtgctggagcaggttgggaaggccggcctccagggcggccaggttttcactccccagctcggctttggggcagcccccgtggtgcttgagggcgcggacagtagccaccaccaccaccgcatcggggtggagccgggccagacggcacttaatatccaggaacttttccgcgcccagatcggcgccgaagccggcctcagtgatcacatagtcgcccatcttgagggccacccgggtggccatgacggagttgcagccgtgggcaatgttggcaaaggggccgccgtggatgaaggcgggggtgccctccagtgtctgcaccaggttgggcttgatggcgtccttgagcagggcggccatagctccctcggccctgagatcgtgggcggttacgggggcgccggagcggctgtaggccaccaccatccggcccagccgagccttcaggtcggtgaggctgtcggccaggcagaggacggccatgatctccgaggccacggtgatgtcgaaaccgtcctcccggggaacaccgttgaccttgccgcccaggccgcacacgatgttgcgcagctggcggtcgttcatgtccacgcagcgcttccaggtgatacgccgcacgtcgatgtccagaatattgccctgctgaatgtggttgtccagcatggcggccaaaaggttattggctgcgccgatagcatggaagtcgccggtaaagtggaggttgatgtcctccatagggataacttgggcgtagccgccgccagccgcgccccccttgacgccgaagacgggccccagagaaggctcccgcagggcgacaaccgtattcttgccaaggcggcgcatgccgtccgccagacccaccgtggtggtggtcttgccttcgcccgccggggttggattgatggcggtcaccagaatcagttttccatcggggcggtccgcccggtcgtccagcagcttcagatcgatcttggccttgtattttccgtagtactccaggtattcctcgtccacaccggccacggctgcaatgtcccgaatgggctttatcgcacaggcctgtgcgatttcaatatccgacttcacttccacatccacacactcctttatacacttcggctggaaaagagagaggaagatggcggtgtgcccccgacatcttccgtttaccttccagaatttcaagtttatcgtaacatcctttgcccgccttgtcaaccggaggtggaacgggaaatggaaggtccgggggacaaaaacggaaaaggcaaattcagcttgcctagggcttgtttgaaaattggcgatgtgtccagcggcgaggaattttgggccgctggcaagcaattttttcgcaggaatcctgacggatttcaaggaaaaattgcgccgtccagtggtcaaaaggcccgtcgattgggcatgtcgacatttttcaaacaagccctaggtattaaaattcagaaatgtggaggtcacccgtggaggctggagtaaaaaaagaaagacacgacgtacgtcgtgtctttcttttttggtacggctgaagggattcgaacccccgaccttttgattcgtagtcaaacactctatccaactgagctacagccgcatgtcattgagaggactgtatttgtcctgctcgctgacggcttgattatattagcacaggttggaacagaatgcaagaggaaaataaaaatttctccaaaaattttcttcggccgggagaggatcgggtcaagtggagcgctctccctctgcaacaatgcgctccaggcaggccatcagatccgacatggtctccagcttgacatccatctgcaaaatgtgctcccggagctcgggtggcatggagtcaaactttgcacggatagcgggattgacataggacatggaaatcacctcgccgatagtatggacaggggtacggaaattcataccatgaaaggcaataaaaacgcgctccggaaccggagcgcgggagtttttggtctgtcccccacagagaggcgtctgccaccctgcgggggtacagtggttttgggtgtttgaaaagagaggaaagagaggaggagtcttgattgattgctctggtatcctgacaatctctattttaacaggtctaagcccaaagtgatgaaccattttcaaatttagtatgaacgttttatgaacgcggaaaacgactttttccctgggtaaagggaaagaaaaatggccatataccgccaggcatgccaatgagcgagcgtactcgcagcgcatgaagtgctacacagtacgaatgcggtacagggcgttgagcacccgccagttctgggggaagggccgcatcaggttccaatagccaaccccgtatagaccatattcggggatcaaggccagcttggcctgtatgctacgggcatcctcaaaccagacctcatgggttatgccgtagccatcagtatagcggtaccagggggcctgggcctgctcgctgtattggatatccacaccgtagcggaccgccctggccaccgcttcctggggggaaatggactgagccttggtacgtccctgcacaaaggggagcggccagtcgtagccgtagagggggacgcccagccagattttggaggccgggatttccgtcagggcatactccaccacttggcgcacattgggcaggggagccactgccatcggcggaccataggtatagccccactcataggtcataaggagtacctgattaactgccgcaccgatggcggcgaagtcgtggccctcatacagtgttccgggctgatcggcggcaattttgggggccaaggcggcgataaccggatagcccaggggattgagccgctctgtgaggcggcccagaaatgcggcataggcccccgcatcctcggcgtagacatattcaaaatccacatccagcccccggtagcccttttgcaccagcatggcctccagattgtcaaccagcgtatcctgtaccgcaggctgagtgagggccaagtgggccagctcattggagaagccgccctcttcggtcagggtggacaggtgcatcagaggagcggctccaccttggcgggctgcggcgagcagggcctcgtcatccaactccaccagcgtgccgtcaggggtaaagccataggtaaagggggtcagataggtgagataagggacggtggattggagcagcgccgggtcgataaagggataggcgtagccgttgacggagagggtggcctccggcgtgctgtcgtaggcgagcaccagggtctggccaggatagatctccgggataccgccaagtatgggattgttgcggtagagctggcgcagtgggagctgataggccgcggcgatggaggccagggtttctcggggctggaccgtgtgggtctgggttggaaattgaaccaccagcgcctgccctacagccagacgggaggaggtttccaggccattgtccaagatgagctgggacatgggaatgccgtactccagggcaatggagtagacagtatcgccgggtttgactacatggatgagcatggcagtacctcagagcagggtgatgaaatccgcgttggcccaacccaccacgctgtcaaagcgcaccacataccagttttgccactggttgaggacggtgagccgcgccccatcataggccctggccaggacgggagaagaggtgtccggcttatcccggatattgagatagccccaggagacatccactacggcaggacgcgaggggcgaggctccaggaagggcacgccgaagtattcggtcagggagagcacgatgttgcgggccacggcctccagattgtttttaatccacgcagcatcgtccgcgttgtcgtggtagcccagctcaagaaagacggagggagcgcggacacggcgtacctctccgacggaggtagtgggctccgcccgtacctggttgggcagtggatagagggttttcagcccgtccgccaccaatgtggccgcccgctgcccctggacagagccgggatagtagaacaccagaattccacgggcctggccgtactgcctctccggggcggcattggagtggagggccaggtgcaggtcgtagttgccagcgttagaggcacggatggacgaggcggcggtcatgtcgggggtattgcgggagtatcggataccggatgcggtgagatagggctccatggcgtcggccaggcggttcatccactcctcttcggtgcccccgttgacatacaggttgttctcctgggtggagggggagagatagatgatgggcatagggatacctcctttttgctccatcctatgcacggagacgccgtagggtcattgcggagataaaagcagggcccgccgtgttggcacggcgggccctacttattcccatcggctcgattcagttgagccgggcatccaggatatccagctcctccgagagctgacggggcagcttgtcgccgaacttctggtagaactcccggatgcccttgacctcgtcccgccagagggcggtgtccacgcccagcaggcccctgagagtgtccggctccacgccggagtcctctaggtcgatgtcctccggccggggctcccagccgatgggggtctccaccgcctcggcctcaccgaagcagcgcttcaagatccactccagcacccgcaggttgtccccgaagccgggccagaggaacttcccgtcctcgtcggtgcggaaccagttgacgttgaagatcttgggggccttgccgcccagcttctcccccatgtccagccagtgctgccagtagtcgcccatgtgatagccgcagaaggggagcatggccatggggtcccggcgtaccacacccaccgcgccggcagcggcggcggtggtttccgaggccatgatggagcccacaaataccccgtgggtccagtcccgggactgatagaccaggggggcggtcctggcccggcggccgccgaagacgatggcggagatgggcacgccccggggactctcaaactcgggggagatgcaggggcagtttttggccggcgcggtgaagcgtgagttggggtgcgcccccttctccgaagaggtcttgccgttccaggggcggccttgccagtccaccgcgtgctccggaggattcttgtccagaccctcccaccacacggtgttgtcgtccaggttgtgaaccacattggtgaagatggtgccctgtcgggtggtggccagtgcgttggggttagatttgacattggtgccgggggccacgccgaagaagccgtactccgggttcatggcccacagccggccgtcctcgccgatgcgcagccaggcgatgtcgtcccccacgcaccagaccttccagcccgccttccggtagtgctccggggggatgagcatggccaagttggtcttgccgcaggcggaggggaaggcggcggcaaggtagcgcacctcgccctgggggttctccacgcccaaaatcagcatgtgctcggccatccagccctgctgccggcccaggtaggaggcgatgcgcagggcgaagcacttcttgcccaatagcacgttgccgccgtagccggagttgacgctcatgatggtgttgtcctcggggaagtggacgatgtagcggttctcggggtcaatgtccgccttggcgtggagccccttgacaaagtcgtctcccatcacgtcggccacggcccggcctacccgggtcatgatggccatgttgagcaccacatagatggagtcggtcagctcgatgccgtacttggcgaagggggagcccaccacgcccatggaataggggatcacatacatggtgcggcccttcatggcgccggtgtaaagctttttcagcttggcgtacatctcctgggggtccatccagtggttggtggggccggcgtcctcctgctttttgcagcagatgaaggtgcggtcctccacccgggccacgtcgtttaccgctgtgcggtggaggtagcagcctgggagcttctcctcattcagcctctcaatctccccgctggcgcaggcctgcttccgcagctcctccagctgggcctcgctgccgtcaatccaaacgagctggtccggctgggtcatggccgccatctcgtcaatccatgccagtaccgcgcggttgcttgtcaatgccatgaaagtgtcccccttttgtgatgtaatgcagaaaattctgttagctgtattgtaaaagaaacgggcggtttttgcaagtccttttcgtcggatttgcaaaaactgcccggtatactggctcagagacggttctggagggcggaggccagagtggaaaattcaggaatacccagccgctcgccccggatatcggcgggcagcccggcggcctcgatggccccgcgcagcgcgtctttggacaggcggctgccgaaggcggaggagaggccgttgaggagcgtcttgcgccgctgggcgaaggaggctctgaccacctggaagaagaagctgtcgtccaccaggttctgaggaggggcggagcgggggacgagccggatcaccgccgaagtgaccttgggggcggggaggaagcactccggccccacctcaaagagcagttccggctgggtgtgatactggcagaacacagagaacgccccataatcgctggaaccgggggcggcgcagatgcgcagggccacctcccgctgaatcatcaccgtgatggaggcgaagcacccggcctcaatgagggcggtgagtaccggtgtggtgatgttataggggaggttggcacaggcaatcgctgtaaggccagaaaacttgtcagacacaagagcggccagatccagcttcatggcgtcccccggcaccacctcggcgttggggtagggggccagcgtctcggccagaatgggatagagggtgcggtccagctcaatggccgctaccttggccgcccgccgggccagctgcaccgtcaaagggccgatgccagggccgatctccagcacgccggtatccgggcctgcgccggaggcctccgcgatgtccctgggtacccatccctcaatgagaaagttctggcccatgcttttggagaagcggaagccgtggcggcccagcagggcgcggatgtccttttcattgcataaatccattgggaatcacctcgtgtcccagggagcacatcacctggaattcctgttgaaaatctgtaatggctttttcctttacgaggaaaagggcgtcaaaagcgtccagcgcggccgcgtcgggggcataggcaaagccctcgcggaagcgcccggcggcgtttgccagggagccgggggccagctccactgcctggaggccgggcaggtactggccgttctccagggagatgccccagcgctctccgcaccagaagccgtagcggccgtagtgccggggatcgcccagaatcaccacggcctgttcccccagggcctgggcctgccgcagggcatggcacaccagggcgcgggccagtccttttccctgaaaggaggggaggacggccaggggaccgaaggtgacggtgtccagatacccgcctgcctccagctcgatggagctggaggcgcaggcgatctgcccggccaggacgccgtccgcctcgcatacgaaggtcagctccgggcggaaggcgggggactgacggagcagatggagatagtagtgctcgtcgcagccgggcttgtagacgttccaaaaggcctcccgcaccagcgtttccgcggcgcggcggtcggcgggggcctcgtggcgaagggtcagtgacatagtgaatacctcaagcaacagattttgttcgtataccaggaagcatgagcggaatggtataattgtgatatgttttccggctgccccgcaaggggcggcaaaacggctgaaatgcaagcgtaagagccgctttcccgctattataccataaaaaacagggacaggctatgcctgtccctgttttttcagcgggcgcttcaacatcagcagggtcttgatgtcttccacaacctccggggagtccacctccagggacagccaccgcccggagcccatgggcttgaccgcctgccagcaggcctgggtatactccgagagggtggggagaagggcctccgcctgggccggggccaccaccaggcaggcgaaggcgccggaggcggggtagagggtacacagggccttgccgccggagcggtacttgacgttccagccccgccccatggaacagctgctgtagctgtaaatacgggaaagggaataggcttcacagatccagcggttcaatggttcccacagcggatgggatacataggcggagagctgctccgctgtgggctcctccggcccgggatagatggcgttccagtccattagttgcgccaccggagcagactggggaagaactgggccatctgcgcccgggcctgctcgggggtcagctcggggttggcccgcaccatcatgggagtgcagaagtcgatcatctcctccatggtcatctctccggtaaaggctccctcctgataacagtatttgcagtagtgctcgctgggcgtgccgccccgctccgtgccgcggagggccggggcgtcgatgggcatgccgcaggattgacaaaaggtgtgattcatgtgagattcctcctgggattgagatggctccatcctatcacagttatcctgacacaccgtgtcatggtttccgtgatgcgccgccatttttcccgccagcagcgccagccgtttccgcaggcgctccggttccaatacctccacccccaggccgaaggagagcagatagccatagagccacggatcctccgggaagcttaccgacaccacaaggctgccgtccgccccgcgggtgacgcagccctcgtcgaattcgtcgtagacccggtaggcaagggcgggggagaagcgcaggcggacaggcacgcagaagccctccggcggctctccagcctcgatgggcgggggagagagggggcgctgaaagggggcgcccggctccggctccagcatccgggtgagcttgaaggtgcggtaggccgcccgctccaggcagaatccctggaggtaccagtcccggcccttgaagaccagccgggcggggaggacgctgcggcgggtggtctggccggaggcgcccacataggtgaaggacaggacgcggcgggacagaatggcctccttgagctggacgaatttggcgttgtcggccccggcgctcccccatcgggacagctccacctgcagccagtccggttcccgacgccggaacagggcggacagcttggacagggtccccgccgtcccctgaccggcgtccccgggcaggctccgcagagcggtgagcagcagctgctgttcttcctcggtgaaagcggcccggtggagggtatagccctccagcagggacaccccgccgcccttgcccggcgcgctgtataccggcaccccggccgccgacagcgcgtcgatgtcccggtagatggtgcgcaccgatacctcgaagtgctccgccagctgcggcgcggtcatgcggccccgctccagcaggagacagagcagctcaaacaatctgccctgggacatcagcggtttctcagccgggccatcaccagcgtgtccacgtaggcccccgctttcacggcggcctcccgcttgcacccctccgtctcaaagcccaagcgctcgtacaggcggatggcgcccccgttgtcggcgtagacctccagctccacccggcggagcatcagccaattgtccgccagatccaagaccgcctccaacagggcggtgccgatgccctgtccctggcagtcggtgcgcaccatgatgcccaggccgccggcgtgccgccgccgggggttggactccacggtcagcatgaccaggccgagcacggtatggtccggcgatacggccagcagaacatgccggccctgtcccggctggcggagaagctcctccatacggcgggggcggtcggaggggagggaggccgcctgttcaaatacgccgggcatccgccgcagtgcggtgatctccgcggcgtcttccggcccggcggggcggatggtgtaggtcatggcgcggtcacccccggacgaatgcgggccatcttgtactcatccacatagcggccgttccgcaccgtggtcatgcgcagcaggccttccttctcaaagcccagcttctcatagaggcggatggcctgctcgttgtcggcaaagacctccagctccacccgcaccagcatgagccagtggtccgccagatccagcagtgtttccatcagggtggtgcccacaccccggccctggtagtccgcatgcacaaagaggcccaccgcgcccacatggcgcatccggggattggagcagaccgtgaggccggcgcagccgattaccgtgccgtcgtccagaacggccacaaagttatggtcgtcagggcccagcccggcgatgaacgcctcgctgtcggcggtgcggtaggaggggaggccgagcgtattctcaaatacgcccggcatgcggcgcagagctgcggccccctccgcgtcctccggcccgatggggcggatggtgtagttcataaaagcacctcccaaaactatttttgccatgatagcacaggcaggggcaaaaaacaaccgcccggaggaaatttcctccgggcggttgcggaatggcttgatcgaaatcaataggccacgacgatgccgccgtcgttggcatagacggtgctgatgccgccggtatcgctgatgaggatctccccgaaacggcactgcttcatgaccagctccttgacgtggaaggcccgctccaggcagttgcagtggacgatggacagccggcgcccctcgtgcttgggatccgccgccatcagggacaccatcttggacagggcctgcttgatggacatggcctggccctttttgcagatctcaccctcgggggtggcgcccatgagcagcttgatgtgcagggtgctggtaaccagggactgcaccctggtgagccggccgtttttccgcaggttgtccagggtttccagcacaaagtaggtctccatctcattgatgtagcgggagacctggctgaccaccgtggtgaagtccatgcccgactgggccagctcctggattttcagggccaccagaacctcgcccgccgaggcggagcaggagttgaagatgtgcacattggagttggggtggtcctccagccagaggctccgcgcctgggccgccgcgttgtgggagccggagagcagggcggaaagagtgaccacatacaggtcgtcggcgccgcagtcaaacgcctccagatactggatgggggaagggcaggaggactggggagccgtggcactctccttcatccgccagagcagggcaccctggtcaaaggaggcatcgtctaccacgatatgctcacccacccggatggtcagcgggacgctgacaaagcagtcctcccggagctgggcgggcgttaaatcgcagcaactgtcgacaatgatcttaaaactcatagctggaaccctcttatataataatgaaaattagattactagtgtgcagtcattgtagcacgggcgggcggaaaagtaaaggggaaacctgtaaacaaatgattgcgttagaattggggggcttcctcgtccagctcccgcagcagcttttgatcctccttggaggaaagatccagtctggcgtagagatccgggcggcgctggcgggtgcggaggatggactgcttgcgccgccaacgggcgatgttcttgtgatcgccggagcggagaatgggggggaccttccggccgtgccactcctcggggcgggagtactgggggtactccagcaggccgttccagtggctctcctcctcgaagcactccgggtcggagagcaccccgggcaccagccgggccaccgcgtcggccaccaccatggcggccagctcgccgccggtgagcacgaagtcgccgatggagatctcctcgtccacacactcctcaatgaaccgctcgtcgatgccctcatagtgcccgcacaccagaatcaggtggtcgtaatcgtcccgcaggcggcgggcgtcggcctccacgaaggttttgccggcgggggacatgtagatggtatgtcccgggccgaaggtgtccacaatgtgcttccagcactggtagagggggtcggcctgcatgaccgcgccgtggccgccgccgtagggatagtcgtccacctgcttctgcttgttgagggtgtaatcccggatctggtgggcctcgatgcgaatgatgtcccgctcctgggcgcggcccaggatggactcgttcatcatatcgcccacggtcagatcaaagagggtcataatatcgatcctatacatcggtacgcattccctcgatcagacgaaccttgatatagccgccctccacattggtctccgccaggaactcgtccacggcggggatcatgtattcatgctcgcccttcaccacgtagacctcgtgggcgggcggggtgagcacgtcggccacaacccccagcttctccccgctgccggcgtccaggacctccaggccgagcagatcggcgataaagtgccgcccctcgggcagcaccacgccggagcgatcgatggagacgatcttgcccttgagggccatggcggcattcacgtcggcgacgccctccagcgcggcgaggacattgcccttgtgtacccgggcggcgcgcacccttacgggcgttccgtccagatagagggtgccgaactggagcagaaactcggggctgtcgcaccaggggacgattttgacctcgccctggatgccgtgggtattcacgatctgcccggcctccagaaactgatttttcatttgaaatacctcccgcaggcggcgcgtccaggaggccgcgccctacattgaaaaagcggcggggctcgctaccccgccgctttttagtcgacgatttcgacggaaaccttggtgccctggcgctgggccacggagcgcatcagcgtgcggatctccttggcgatgcggccctggcggccgatcaccttgcccatgtcctcgggggccacccgaagctccagaacggtctcactctcgcccttgtgctcggtgaccgacaccgcgtcggggtgatccaccaggttccgggcgatataggtcagcaattccttcatgccagccgtgacctccattagatggcgccagcttttttcagcagagccttcacggtctcagtgggctgggcgccagtcttgatccaagcctgggcgcgctccgcgtccaccttgatctcggcgggctgggtcagaggattgtaagtgccgatctcctcgatgaaacggccgtcgcggggatagcgggagtccgccaccacgatgcggtagaagggagccttcttggcgcccatccggcgcagtctgatcttaaccattgtatcttcacctccatgtaattgttgcacatctatggaaacgcgccgcagcgcgcttaccaaccggtcagaaggggagtcccggcagcttgccgagctttcccatttttccaagtttgcccatgcgcttcatctgcttgccggagaactgcttggtcatctgctgcatcatatcgaactgcttgagcaggcggttgatgtccacgacctgagtgccggagccggcggcgatgcgctttttccggctgttgttcagcagggaggggttctcccgctccgccggggtcatggacaggataatggcctcggtgcgggccagggcgttctcgtccacgctggccccttccagtgccttggcgttcatgccggggagcatcccggcgatgtcggacagggaacccatgcccttgatctgaaccagctgatcgtaaaaatcagccagggtaaacttgttcttgcggagcttctgctccaactcggcggctttcttggcgtcaaaggtctgctgggccttctcgatgagggagagcacgtcgcccatgcccagaatacgggaggccatgcggtcggggtagaagagctccacctggtccagcttctcgcccacacccacaaatttgatgggcttgccggtgaccgccttgatagagagagccgcaccgccccgggcatcgccgtccagcttggtgagcatgacgccggtaatgtccagcgcctcgtcgaaggtctttgcggcattcaccgcatcctggccgatcatggcgtccacaatcagcaggatttcggtggggtcaatggcggccttcatcaccttgagctgctccatcagctcctcgtccacgtggagccggccggcggtgtcgatgaacacaatatcgttgccgtgcttcttggcgtgctcgatgcccgccctggcaatgtccaccgggtcaatctggcccatctggaacaccggaacgtccacctgctggcccaccacctctaactgggtgatggcggcggggcggaaggtgtcgcaggccaccaggaggggccgcttgccctgcttcttcataaagcccgccagcttggcgccgttggtggtcttgccggcgccgttgaggccgaccagcatcaccaccgtggggggcttgggggagatcgtcagcttggtgttctcgccgcccatcagggcggtcagctcctcattgacgattttgacaatcatctgggcgggggtcaggctctccagcacgtcggagccgatggcccgctcggtgacggtggccacaaactgcttgaccaccttgaagttcacgtcggcctccagcagggccatgcggatctccttcatggcctccttcacgtcggcctcggagaggcggcccttgccgcgcagcttcttgaaggcggcggagagcttttcggtcagtccttcaaatgccatgggttactcctgtttcaactgggccagaacgcccttgagctgtccgcacagggactccagctcgtcgtcctgccaatgggcctcgttgcgttgggcgatggcgtccaccgccgtctccatctggccgaactgctcctgcattctgtggaagcggcggatgatgcccgtcttgtcctccagctcggtgaggatggcctcggcgcggacgatcacatcccggacgccctggcgggtgatgccgtagttctccgcgatctcggccagggagagatcctcattgtagtagaggtcgtagaactccttctggcggtcggtgagcatgtcgccgtagaaatcatagagcagggccatgcggtatgcctggtttttcatcgctgccgcctcctcccgtgtgccggttttctgtaaaggtggtaaagctacggagctttacaacagaagtgatgatactataaattggccggattgtcaagagaaagattgcgtcttttccggctctgcggcgtaccagagggggaggcccagcaaaaccgcgccgcccagcaggttgcccaaggtgacccacagcaggttccagcccatggaggcccagtccgcgccgccgttcagcagggcatggagtgcgaaataggccatgttggcgatggagtgctccagtccggtgaggacgaaggtggtgatggccagggtgatcaccagggccttggcggtctcgctctggaggcggaagccggcgaacacgccgatgcacaccagaaaattgcacagcacgccccggaggaggagcagataccagggggcggacagcttgcccgggacgatcagggccagataggcccccaacagctccccgctggagccggagccggccagcagcaggcagagcaccagaatgcccaggagattgcccaggtaggccagcgcccagacacggagggttccggccaggcggacccggccgtcgtagagggatacgctcatgaccaggatacagccggtgaacagctcaccacccagcaggacaatgagggtgagagcggcagagaaggccagggcccccagcagcttggccagagggagattggtgtcgtagaaccaggcggcgcagaggctggagagcagggcgcccacaaagataaatgcccccgccagggcggcccgggtcaggtagcggcccggcgcggtgccggagaagcggagcttctgcactccggcctgcgtgatctgttccacaacggttcgtgtcatggtgtggcctccttataaaatataggtaatttcattttaccggaggttgggggcgggagcaagctgccgcggcaccaatcttttttcgttttcctagtgtcaaaaccgtcaaaacgttgtataatatccgatgttgatactttggcagttcccataaggaaaggaatggtaaagctgtgattgaggtcacccggacacagcttctgcccggcgtccatctgacggcggtgcagacgcagaaattcaaatccagcgtgctggggatgcagttcctgctgcccctggcccgtgaacaggccgcgctccacgcgctgctgcccatggtgctccgccggggcaccgcggagcacccggatatggaatccctctccgccgttctggacgagctgtacggcggttccctggagcctacggtgcgcaaaaagggggagacccagtgcgtgggctttgtgggcagcttcttggacgacgcctatactctggacggttccgccgtgctggagccgtcggccgccctgctgggggagctggtgctccgcccgtacacccgggacgaggtattctgccccgactatacccgccaagagcgggagaacctggtcacccgtatccgcgcccaggtcaacgacaagcgccagtatgcccaggtgcgtgtggtggcggagatgtgcgccggagagcccttcggggtggacaagttgggggatgaggcgtccgcggcggccatcacaccccaaaagctgtgggactgctaccagcaggtgcttcgcactgccccgatagagttctactattgcggttccgcccccctggagcgggtgcgggcggcggttcaggccatcgtggacggcctgcccgcaggggagcgcgcgcccctcgcgcgccccgaaaaggggaacgctcccgcccagccccgccgggtggaggaggcgctggacgtgacccagggcaagctggccatggggttccgcacctgcattgacgcctgggacgaggattacccggccctgatgctgctcaatgcggtctacggcggaaccaccacctccaagctctttctcaacgtgcgggagaggctctccctgtgctactatgccagctccggcctgatgaagtacaaggacgtgatgctggtctcctccggcgtggagttctccaaggtgggccaggcgcaggacgagatccttgcccagcttcaggcctgcaaggacggcggctttacagacgacgagctggagtgggcccgccgctcggtggtgagcaccctgatgaccaccctggacgcccagagccgtctggaggattactggctgggtcaggcggccgccggcctcaccgaggcgcccgacgagctggcccagcgggtggagcgcaccacccgggcgcaggtacaggcggcggcccagaagctgacgctggacacggtctatttcctgaaaggcaaggagtgagcccatggtaagcaaagaatacccccgcatcggggagaaaatctatcacgcggagctgcccaacggcctgcacatctatgtggaccggcggcccgagtttcagaagagctacgccttttttgccaccaactacggcggcatggatatgaagttccggctggatggccagtggcgggacactccggcgggggtggcccacttcctggagcacaagatgttcgataccgaggacggcaacgccctccaggatctggcggccaacggggcttcccccaacgctttcaccagctcggccctcaccggctactattttgaaagcacggagaaattctgcgacaacctgaaaattctcctctccttcgtgtccattccctggtttacccaggagagcgtggacaaggagcaggggatcatcggccaggagatccgcatggtggaggacgatccggacaaccaggtgttttacggcctgatggagtgcctgtttgatcaccaccccatccgggtgcccatcgccggcacccaggagtccatctcccacatcaccgccgacaccctctacgcctgccacaaggcgttctacaccccctccaacatggtgctcactgtggcgggggacgtggagccggaagaggtggtgcgcattgcccgggaaatcctgccgaaggagccgggcgggcacattgagcgggattacggcggggaggaggacggcgcggcggccaagccggaaaaggagctgcgcatggaggtgtccacccccatcttccagcttggcttcaaggccgagcccgcccccgccggggaggagcacctgcgccgccagctcatgggcgagctggcctgcgaggcgctgctgggcaattccagccccctgtatgccaggctctacagcgagggcctcatcaacaagaactttggctacggctttgagctctatcccggctgtgccctgatggcggcgggcggcgagagctgcgatccccgtgcggtgcgggacgccgtgctggccgagggggcccgcatcgcccaggagggtgtggacgagggcctgttccgccggctgaaaaagggggtgtacggcgccaaggtgcggggcctcaactcctttgaaaacgtgtgcatcgaactggcccaggcccactttgccggtgtggagtacctgaccttccccgaggtgttcgacggtatctccaaagccgatgtggaggactgcatccgccgctgggtaacgccggagcggtgcggtctggccgtggtccggccgggggaggaggcatgatgggaaccgtctcctttcccggcctgggtctggaattccacctgaaccgggtggccttccacatcgggagctggccggtgtactggtatggcatcatcattgccgccggattcctgctggccgtcctgtactgctgccatgcggccaagcgcttcggcatcaagcaggacgacatcatcgacatgctcttttttgccgtgcccctgtccatcgtaggggcgcggctgtactacatcctcttttacctggacctctaccgccgggaggacggttccctggactttggagccatggtccgcatctgggacgggggccttgccatctacggcggcgtcatcatggcggttgtcgtcctgctggtgttctgcaaggtgcggcagatccgatttctggcctttgcagacctgggggtgttcggtatgctcatcggccagatgatcggccggtggggcaactttgtcaatattgaagcctacggcggccccacagagctgccctggcgcatgggcatctatgcctatgtggacggagtgcggcagtacatggaggtgcaccccaccttcctctatgagtctctgtggaatctgctgggctttgcccttctggtgcagattgcacggcgctggcggaagtttgacggccagatgttcctgagctattttgcctggtacggcgtgggccggggctttatcgagggcctgcgcaccgacagcctgtacctgttcggcacctccatccgggtgtctcaactgttcggatttgtcaccgcggccgtcgccatcgtgctgctggtggtcaacctgggcttccgcaaccatgacccggccaagctgtgggtgaatcagatgaagcggcgggcccgccgggtggcgctggtgtatccggctggagtgcctgcggcggagaagtggctcaaggcccagaagaagagcctggagcaggagtttgccaagaccgaggagtatgcactgcctaagggaaccccggctgaggaggctgcggagttggtggcctccctcaaggcccgggaggatctcagcgaggtacgccagccaaaagcgggcagataaaaaataacagaggcgacggacatcctgtccgccgcctctgttatttataggtagcgtctgaccgagccgcggtagcgctcgtaggccgcgccgaaggtctggcggcaccagcgctcctcggcccggatgacggtgtgggcggtgagctgaaagacgaggagggcggccagaagcggtagcgactgcgtgaggaggacgcagcctagaaagacgaaaaaataggagacatacatgggattgcgggagatgcggtagacacccttgtggcgcacgccgctctccgagggggccgcgaagccgatgacggagagcaggagaaggagcaggccgaatgcgtagagggccgctccgctccagaagaggggggcgggcgcagtatggaccgacgcgaagaaggggcccagcagcagggcggcgctggagagctgatagggccagtaggcaggcttttcgggcccgcggaacggggggaagtgggcggcccgccggagtgcgctgctgtccagcatggagagcactccgaagcgcaggcttagaaatggaatcagcagaacggccgccatgatatgtcctccctgtgtcatgataacccattatagcacggggcggcggggaggggaagaggaggaaagggcgggatacccatgggtatcccgccccttcctgttgtttgccgggctcagcccagcagcttgctctccagatcctggagcataatgtccagagcggtgatgccgccctcggcggtgtaccatacggcggggtgggccagatagacgatattgccgttcttgtaggcatcggttcccatgaccagctcgttctccatgatttcctgggcgagctgggcgccgtcagtttgaatagcggcgtcccggtccatgacgaagatgtagtcggggttcttctccacaacgaactcgaaggaggcctcgttgccgtgggtggaggtgtcgatgtcagcatccacgccgatgttctcaaagccgatctcccggccgatgatggagcagcggccgtcgttgcccagcacgttgaagccgccgctggtgcacatacccacaacggcggtcttgtccgcggcgaagtcggccagggtctggatgcgggcgtcaaagccggccatcagctcgtccaccttgtcttccagaccaaacatggaggcgatggtagcggcgttttggcggacgctctccaccacgcccagctcgctgtcggtggcgaggtagaccacgggggcgatctcgctcagggcgtcgtaggacttggccaggcggccgccgatgaagatcacatcgggctgggcggccatgaccgcctccagatcggcggttttgatggtgcccagattggccacgttctcatcggtcacatagctctggaggtagtccagggaggtgtcggcggagccgacaacgcggcccccggccacgcccagggcatccagaatatccagggaggccatgtccagaatggcgatgcgctgaggatcgtaggggacctccagctccacggcctccttgtcggcgttcagggaggtgatggtgacggtttcgggggcggagggagcctcggtgccagccgcagggctctccacggcgggggaggggctgccggtggaccgggtgtcgtctccaccggtggagcaggcggtcaggcccagtgcgagggccagggcgagtgcaagagagattccttttttcatgtgtgttctccatttctaagcgaatgttcgcggttgtttgagcggcagggtcaatagtagatggacagggggcgaccctcgatctccatgatttcaaagtccacctgatagatctgcgacagcgtttccttggtcatcacctcctcggttccgaatttggcgatccttccgtccttgaacgcgcagatgtagtcggaatagaaggccgcgtagttgatctcatggaggaccagaatcaccgtctttcccagctcatcgcagaggcggcggacgattttcatcatgttggtggcgtgatagatgtccaggttgttggtgggctcgtccagaaggataaactcggtgtcctgggcgatgaccatggcgatataggcccgctggcgctggccgccggagagctcgtcaatgaaccggtcctgaaagggctccagctccatgtaggcgatggccttgtcgatgatgcgctgatcctcctcgttcagatggctgcctgagtaggggaagcggccgaaggtcaccagctcccgaaccgtgagcttcatctgtatgttgttgctctgggtgaggatggccagccgcttggccagctccttgctcttccacttgccgatgtcccggccgtcgaagtccaccaggccgctgtcccgggcgatcaggcgggagatgatgttgagcaccgtggacttgcccgcgccgttggggccgatcatggagatgaccttgcctttcgggatttcaaagctgacggagtccaccaccgtcttgccgtcgtactgtttggtcagatccttgacacgcatgggttacaccctcctgttggacaaaagaagatagagaaagtagacgccgccgcccacggtgatgaacacgctgatgggcaccgcgtagtggtagatacgctccaccacaagctgtcccgccaccagcaccaccatgcccaccagggcggagcccagaatcaaataggtgtggcggtaggtcttgaagagctgacgggcgatgttggcgataatcaggccgaggaaagagatggggcccaccatggcagtggccaccgcgatgcacagggtgacgcccagcagcaggcggcggatgctccggtcgtagtccactcccagattgatggcctggtgcttgcccagggtgagcacatccagcagggccagatcccgccgcaggacgaagatcagccccgccagcagcaccagggcgaagacgatgatctcggagttgatgttttcaaagtccgccaccagggtggagagcaggctgtcgtactcattggggtccatcacccgggtcagcgtggtctggatgctggagaaaaaggaggagagcacggtgccgatgagcaggacatagagtacattgtggttcgttttttgaaagagatagctgtagataatggtggccacaatgcccatcaggatcacatccgccgcgaaggacaggttcgcgctgcgggccagaaggctgcccgagccggcgaaaaagaccaccgccgtgtgaatcagggtgtagagggagttcatacccagcaggcagggggtgacgatggtattgttgatgatggattggaacacgatggaggcgccgccgatggcaaaggcggtgatgagcatgactaccagcttgggggtgcggattttcatggagtagagcatcaactgctggctgccgaagttgaccgccacaaccatgtagcacaccgcggccagcagaaccagcagggccagcagagtcaccttgcggacgtttgcccggtaggaggcggagggaagggctgtgcttgtccggttcatgcggcgtcacctccatccagatgggccgccggggcgcagccgcagccggcgccgcctcccgtgagacggatcgccttgcggccgtggcggagccggtagagcagcagcaccacgaagataaggctgcccagtatgcccacaatcagctcgatggggagctcgtaaggggcgatgaccacccggccgatcatgtcgcaccccagcacgaagacggcgccgaacagggccgtgtccatcagcgtgccgcggatcttgtcccccttgaacatggccaccacattggggacgatcaggccgatgtaggagatggagcccacgaccacaaccacgctggcggtgatcatcgcggcgatggtcagcccgaggaacagcaccaagttgtagggcacgcccaggttcttggagaagtccttccccataccgacaatattgaagtggttggcaaacagaaaggccagggtgaccagcggtacgatcaggtagaccagctcataccggccgcggagcaccatggagaagtggcccacggtccaggtggacagggcctgagtcatctcatactggtaggccagatagttggtgaggccgccgatgacattgccgaacatgatgcccaccaggggaaccatgaccacgtccttgaactggatgcgctgaatgaaccagacaaaggtccaggtacccagaacggcaaagacgaaggagaaaagcgcccgtccccacagagtggagtttggcaggaacaggagggccagaagaatgccgaactgggccgaggagatggtggctccggtggtgggagagacgaatttgttcatgcagagctgctgcatgatcagaccggccacactcataccgaccccggtacacaggatcgccagcaggcggggcagacgcgagatcagaaaaatctccagttgttcgagctctcccgacagcagcccggacaggtttatatcgatcacgccgagaaacagtgaccagatcgacagcaccagaagggccagtgccaagagcagggtggaaagatgtcgtttgatgggaggtcctcctctcaaggttgtaattagctataactaacttttgggcaaaaaaagacagcgcaccttgtgagcaaactggacttacatgccgcatcacattgcacgtcgctcgggactcagtaaagtggttagcaataacaaactgagtttgtccatagggtaccatatccggggagaactgtgcaagcggtgattccgacaaaattatgaccgccaatctatggaaaatatacaaaatagataggaatagtgaatataaatagaaggggcataaacggggacaggcgttcataggatgtgccaagtacaaaagaaggacgtgagggtatgtcggaagaacgaaatgcagtccggttccgccaggcggcggctctgctgccgccccatctcaggcggccggtggaacggctggatgggacaagccaggcccgggtggaggagctccgcctgcgggcggggcgtccactgactctggtctgcccggagggtgagcggacggttcctggtgcggaggcgccggtgcgttccatggatctgagcctggtgctggagattgccactcaggcctccgcccatacggcgctggaacgggtgcgcaacggcttttttaccgtacgcggcgggcaccgcatcggcatctgtggaagcggcgtggtgcgggatggggaggtgcgaaatctgcggcagctctcctcgctggccatccgggtggcccgggaggtgccggggctctccgcggcggtcctggacaggctgtggagtgggggcgtgctccagagcacactgctcctctcgccgccgggaggcggaaagaccaccctgctgcgggatctgatccgtgccgtctccgacggggagggcggccccgccctccgtgtgggggtggcggacgagcggggtgagctggccgccatgtatcagggggagccgcagttctccatcgggcggcagaccgacgtgctggacggctgccccaaggggccggccctgctgatgctcctgcggggaatgaacccccaagtgctggcggcggatgagatcaccgcgccggaggacgctgcggcgctggagatggcggccaattgcggcgtgtcgctgctgtgtaccgcccatgcggggagtctggaggagctgaaggcccgtcccctgtaccgccgcctgctggacgaggggctgttccggcggctggcgatcatcgagcgggcagggagggaacggcgctaccaggtggtggagctatgctgaagctgatcggggcgctgctgctggccggcggggcgggggcgctgggctgctccgccgccgcccagctctcccgccgggtggcggtgcttcgggctctgctgggggcgctggaggggatggagcgggagattgccttccgcctgacgcccatgccggagctgctggagcgcgccgcggcggagagccctccgccggtgtgcacgctgtttgcccgctgccggaccctgctggacgagctgggagagcggtccatggcggagctgtggcgggaggccctggagcaggtgcccctggggctggacggcccggggcggctggccctggaggagctgggggaggtgctgggccgctatgacggggacgggcagcgggaagccctcgcccacacccgtgcggagctgtcccgggcgctggagcaggcccgggaggcccgggaaaaacaagggaggatgtaccaggtgctcgggatcacggccggggcattcctggttatcctgctgctgtgagggagcgtgcgatatggatgtggatttgattttcaagattgcggccattgggattctggtctcggtgctcaatcaggtgctctcccgctcggggcgggatgaacaggccaccatgaccaccctggccgggctggtagtggtactaatgatggtggtgcagcagatcagcggcctgtttgaactggttaaaaacctgttcgggctgtgaaccatggaggatattctgaagattgccgccgccgccgtagccgccgctgtgtgcgccgtggtggtgaagcagcgggcgcaggaggtgggtctggttctctctctggccgccggagcgctggttctgaccatggccctgggggcggtggagagcgtgcgcgccctgatggacgagctgggcgaggccgccggcctgtcgccggcagtgctggcgccggtgctcaagaccgtgggtattgcaatcctgacccatatttccgccgaggtgtgccgggacgcgaaggagagcggcatcgcggccttcgtggagaccgcgggggccgccgtggccctgtgcgtggcccttccgctgctgcgggcggtgctggacactgtgacgggactgctgtaaaagacgaaggggatacgaatgagacgaagaatactgatgtgcctggcggttctgcttctgctgtcgggcatgggggcggcctcggccagcgatgtgctggccgcccagtcggaggcgctggatctggatgcgctccaggacgcggcggggggctatctgcccgacggagcgctggaggcgggcatcagtctggatgaagggctccaaaccattctgaataccggcagcggacagatctctggtgtggtgcgcaaggctgtgcgcagcggtgtgctgctgctgacggtggtactgctgtgcggcctggccgaggggctgtatggcggcatgggggtgagtcagaccaccgatgtagtggccattgtgggcgcactggccatcactgcggtggcggtggcggacgccaactccctcatcggaatgggacgggaggcgctggaacagatggagaccttttcaaagatactcctgcccacgattacggcggcggccgccgccgcaggctctcccagtggggcagtggcccgccaactggccaccatgctcttttccgacatactgattactctcatcaaccgcctgctgctgcccctggtctatacctacatagccgcctgtgtggcctatgcggcggtggggaacgaggggcttaagcgcatcgcaggcaccctgaagtgggtggtgaccagtatactgaccgtggttctgctggtttttgtgggttatctgaccgtcagcggtgtgattgcgggctctaccgacgcggtaaccgtcaaggcggccaaatttaccatgtccagcctggttccggtggtaggcggtatcctgtccgacgcggcggaaaccgtattggccggggccggaatactgaaaaacgcggtgggggtgttcggcatgcttgcggtgctgtgcatgtgcgtggcgcccttcctccagctcggtatccactacctgacatataaagtgacctccgccctcagcgctaccgtttccagcggccgggtggcggggctcattgaccagatcggcggcgccttcgggctggtacttgggatgaccggagccagcgccctgctgctgctcatctccatggtttccgccattacggcggtggtgaggtaggggctatgctggaactgattcgacattggctggttgggatcacctgtgcggctatgctcgtggctctggctgagagcctgattccggcggggagtatcaggcgcattgcccgcctgaccggggggctggtgctgctggcggctatcctgaaccccctgctaaagctggatactacggcgctgacccgggcactgacggagtacaagctggagctgagcgcatacagcgcggatctggaggaggagaacgaaatcttgatgaaggacatcatagaagaacagtccggcgcatatattcaggacaaggcggccgccctgggcatcgactgccaagttacggtggaggcggacggggaggaagagtggcctattccacagtcggttaccgtcatgggcagcctgacggcagagcagcaggaggcgctggagcggaccattgaggaagacttcgccatcccggcggagcggcagcggtacgaaagcggggacgaggaatgaaaacagagggcttcggggtatggggcagcaagctgcgcagcctgtttgaccggtacaaatttgtacttgtggtgattctggccggagtggtgcttttgctgctgccttccttcggcggggagaagcgcgacggcggggcggttgaaagcagtcaggaatccagttccgaccctttccaggtggaggagctggagcggaagctggaacaggccctggcccagatcgacggcgttggggaggtgcgggtggtgctgaccctgcagagcggcccgcgccggattctggcccaggactcccagagcacagtagatgaggggaggacggaggcggaagtaaccaatgtagtgatttcagccggctccggtgtagagggaacggtgacgttacagcagctttcgccccaattccagggggctcttgtggtatgctcgggaggcggagagccgacggtccagcttcgtctggtggaggcggtttccgcgttaacgggacttggcgcggacaagatatcagtttgtaaaggaaagtgaggaagcaaagatgaaagtgtggaaacgaaatgccgtggtggccgcgatcgtgctctttgtctgtgtggccgtctatctgaactggtcgtatcagagtggagagacggcggatgcgggcaagacactgggggaggcggccctggtgaacggccagaccagcgacccgctggtgggaggaacggcagcgagccccgacccggcatcctccgcctcgcccgaggcagggaccaccggcggcgggagctatttcgactcggcccgtctgaaccggcagcaggcgcgggacagcgccctggcgatcctccaggattccatcgccaatgagagcgccgatgagaccatgaaggaggccaacggcgaggcaatccagaccctggccagttataccgtctccgaggcgcagattgagaacctggtgacggccaagggctacaccgactgcgtggcctttatcggcgatgagagcgtcagcgtggtggtatcggcccgggagggcggcctcaccgatgcggacgtggcaaaaatcactgaaattgtcaccgacgagaccgggatggaggccagccaggtgaagatcatcgaggccgagggataggtggttctggagcgcgcggtgaaaaaccagttgtaatttctctattttgtggtacaatgaaaacgaccgagtagagaaaaggagcgtgaccggaatggcggatggaaaggaatatgtctcccgccctgacgagcttgggaacatccatatttctgaggaggttctggcggtgatcgccgctgccgctgccatggaggtggagggggttggaagcctcgccgccaatctgggcagtgatatcgccgaactgttgggcggaaagaagaacctgtccaagggcatccatatcgcagtggaggaggagagcatccgcgtggatgtctccttactcatcaagtatggctataccattattgatgtggcgaaggaggtccaaaacgcggtatacagtgccatcgagaacaccagcggcctgacggtggagtgtgtcaacgtccatgtgctgggcgttgccttcgaccgggatggaaagaaggcccagtaaagggagaagcaccagacgcgtgccgggttccggcacgcgtctgtgtatgtttttcctggaaaacccggggtgcggagggcgtgccctgggctttttgacgttgcgtggaatttgctcttttctttttatgcatggttgttgtataatacaatcatctatgacaaaaagccgcgggattatcccgccatggaggaaccggaatgaccagaactgctgcccgagagattgccgtccactttgcctttgagctgggctttaccaaccagacggcagaggaactgctggcggaggcgctgaaccgcaagacctttgagcagattggggaggaggagccgctctatgcggagttccccaatgagaagcagcgggagtatatctccaagctggtgaagggcgtgtatgaacacagccccgagctggatgaatacatctcgaagtatgccatcggctggaaatactcccgtctgaaccgggtggccatcgcgatcatgcgggtggccatgtatgagatcctgtatatgcaggatatccccaacgccgccgccatcaatgaggcggtggagatgaccaagcactatgaggagccggaggtcgtgtcctttgtcaacggcatcctgggctccttcgtccgcaacgagtgcccgccggagccggtgggcctcaagccagcggcggagcggccgcaggacgaggcgtaatatgcgcgcactgggcatcgacacaagcaactacaccacctcggcggcggtatttgacggcagcggcggctataacgccggccggctgctggaggtgcgccccggcgagctgggtctgcggcagagcgacgcgctgttccagcacatcaaacacctgcccgggcgctttgccgagctgcaggcggagggctggctgaccggcctgtccgccgtgggggccagtacccggccgagggcggtggagggctcctatatgccctgctttctggcgggagaggggcaggggaggacgctggcggatgcgttgggcgtgccgttttacgccgtatcccaccagcagggccacattgccgccgccgcctggtcagcgggacggctggagctgctggatcggcccatgctggcctggcacctgtccggcggcaccacagagctgctctatgtggagccggacggggtcaatgtcagggcgcaatgcgtgggcggcaccagcgacatctcagccggacagctcatcgaccgcaccggcgtgctcctgggcctgcccttcccggcgggaaaggcgttggacgccctggcgtcggagagcgacttgatagggggatttcctgtaaagctgaacggcctgacattctccctttccgggatggagaataagggaaaggcgctggcagagcagggaaggccgccggcggagatcgcccgctttaccctggagacggtggcgtcggcagtacgtcgggccaccgacgcggcccggaaacgctggcccggcctgccggtgctgtgctccggcggcgtggcctccagccgcctgctgcgtactgttatgagcgacgcagcctttgccgggccccagtactccaccgacaacgccatgggggcggccattctggcctggcggagtctgagacaggaggccgaggcatgaagaacgccccaatttacagcgtaacccaggtcaaccaatatatcaaaggcctgctggaccgcgacggtgctctggccggcctttttgtgcggggagagctctccaactacaaggcctatccctccgggcaccactacttctccctgaaggacgcggagggggccatccgctgtgtcatgttccggcgggaggccatgggcctgcgcttccgtccggaaaacggcatgaaggtggtggcctttggccgggtaacggtctttccacgggacgggcagtatcagctctactgtagtgagctgacccccgacggcgtgggggatctccatgtggcctttgaacaacttaagcagaagctctaccaagaggggctgttcgacccggcccacaagaagcccatcccgcgctatccccgaaaaatcgccctcattacctccccggcgggggcggcggtgcgggatatgctccgcatactgggggctcgctggccgctggcggaggtgctggtgctgccggtgcgggtacagggggcggaggcccctggggagctttgcgcggccatcgcctgggccaaccggcatagggtggccgacctgctgattaccggacggggcggcggctccatggaggatctctgggccttcaacgacgaggacgtggcccgcaccatctatgcctctgagattccggtcatctccgccgtgggccatgagcccgacgtgaccattgcggattttgtggcggatctccgggcggccaccccctccaacgccgcggagctggcggtgccggatcagaacgagtgctatggctggctggagcagatggaaggccgcttgaccggggccatgggccgccgactggagcgggcccgccgtgaactggagcaggccgggcgctgccgggcgctacaggaccccatgaattatatcaatgaccggcggatgctgctggactaccagcgggaccggctggcccacggactgaccggggccatgggccgggagcgggagcgctttgcccgattggcagcggcgctggacgccctgagtcccctcaaggtactgggccggggctatgccattccccagcggtcagacggggcggtacttcgctccgcgaaggaggccatgccgggcgagacgttgcgcctgcgcatgacggatggcaaggtttcctgtaaagtgattgaacctgccggatagggaaaggacgaaatagatggcggaaaagaaagtaacctttgaacaggccatggcgcggctggaggagattgtaaaacagttggaacagggtgacgctcctctggaggatgcgctggccctctttgaagaagggaccagactgatgaagaaatgcaccacacagttggacaaggcggagcagaaggtctccaagctcctggccgggccggatggaaaaccggtagaggagccgtttgagggggagggatagccatggcggagctggaacggctggatgagcaccgggcccggatcgaggattggctgcacgcctgtttccaggactgtgcgccccgtgggaacctgtatgacgccatgcgctacagccttctggccggcggaaagcgcctccggcccgtgctggtgctggaggcctgccgcctgtgcggcggagcagtggaggatgccctgccctttgccggggcgattgagatgattcacacctactccctgattcacgacgacctgccctgcatggacgatgacgatctgcggcggggccgccctaccaaccacaaggtgtttggcgaagccaacgcggttttggccggcgatggccttctgacggcggcttttgagaccatgctggccccgggacagaagcttccgccggagcgtgtgttggaggcggcgggcatcctggcccgggccgccggcggccgcggcatggtgggcggacaggtactggatatggccggcgagggccgcgcccttggcctgaccgaggtggaggagcttcagcgcctcaagaccggtgcgctgatcagagcggctgtggagatgggctgcgccgtggccggcggagcggaggaacagcgggaggccctgtgccgctatgccgactgcctggggctggccttccagattcaggacgatatcctggacgtagtgggtgatgaggccaccttgggcaagcccatcggttcagacgtcaggagcgacaagaccacctttgtggcgctcaaaggtctggcggactgccgtatcctggtggcggagttgaccgaccgggcggtggaggccctggcgcccttcggttcggaggcggagagcctccgcggtctggcgcagtcgctggccggccgcgagaaatgagaggacttatatgagcaatgtcgtagattttctgaccggaaatctgattttaaacctgtccatcctggcctgggcgatcgcccaggtgctcaagtttgtcgtcacgctgatttcccagggaaagctggactggcgccatattctctccagcgggggaatgccaagctcccactctgcctttgtttgcgcctgcgcggcggccatgggctatatgtacggctgggcgtcgcccgtattcaccatttctgccgtggtcgccattgtggtgatgtacgacgcggccaatgtccgcaaggcggcgggggagcaggccaagatcctgaactatatcatggaacactggactgagatgaagcccgccattttcggtaaggagctcaaggagttcctggggcacacgccgttccaggtgctgatgggcggcctattgggtatcagtgtaggattgctgggcgcttggctgtggacgtaattttgaattccgggcctctgtgggccgggaggtggaaccattctgaattttgatttgaatcacgtaccgaatcaactgggagaactgagtgacggtgaggctgtggagctgtgccggctgctgcgggcgcgcctgatcgacacggtttcccgcaccggcggccacctggcctccagcctgggagcggtggagttgattgtcgccatccaccgggtgttcgacaccggacgggaccgtttggtgttcgatgtgggacaccagtgctacgcccacaaaattctcaccggccgcaatcaggcgatggaaacgctgcgtaccttcggcggaattgctggcttccccaaaccggtggagagtgaaagcgacgcctttgtcgcgggacacgcctctaactcagtatcggtggccattggaatggcaagggcaagaacattacaacatgcggactatcatgttctggcgttgatcggcgacggcgccttgtctggcgggctcgcctatgagggcctgtccgatgcgggggacagcggggaaccgctcatcgtcattctcaacgacaacggcatgtcgatcacaaagagcgtgggcggcgtggcggagcatttggcgcgccagcggctgaagccccagtacctgcgctttaagaagggctaccgtaaggtcatgagcgtattgccgctgggcggtcacatctaccatgcaacccacaagatcaaaacggccatcaaggacagtctgttgccgtgcagcctgtttgaggatatgggctttacctacctgggaccggtggatgggcatgatgtcaagtatctgacgcagcttttgagctatgcgaaggagctgaacggccctgttttgctccatgtaagaaccgtgaagggaaaaggctatacaccagcggagcgcaatccggatcagtttcacggtgtcggccgcttctgtgtagaaacaggggagctggtgcatggttcaggggagagcttttccgccgtgtttggagagaccctctgttccttggcagagcaagacggcaagctctgtgccattacggccgccatgcaggggggaaccggcttgaaccgctttgcccgtcagtttccggcgcgcttttttgacgtgggcattgccgagggccatgcggtggccatggcagcgggcatggccaagcaggggatgcgcccggtctttgcagtgtactcctccttcctccagcgcagctacgatatgctgctccacgacgtggcgcttcagaagctccatgtggtgttggcggtggaccgggccgggctggtgggggaggacggcgagacccaccacggcgtctttgatccagcctttctcgacaccatccccggcatgacggtgctttgccccagcagttttcaggagctgcgggagatgctgcgttatgccatctatgacgtggagggtccagtggcagtccgttactccaggggaggggagggcgcctaccagggcaacgtcccggtggagccagccaccctgctgcggacgggagcggacattaccctggcgggctatggtatgatgcttaaccagcttctggactgcgctgaccgtctggcacggaatggcatccaggcagaggttgtgaagttaaatgccattacaccgattccactggagcggctgactgcctctgttcaaaagacaggacggcttctggttgcggaggacagcgcggcggcgggcggtgtggggcagcgcatcgccgcaggcctgtttgacgctggcatccaggtgcgagggctggccttggcgaataccggacacgcctttgttacccatggaacggtgccccagcttcaaaggctgtgcggtttggacggggcgagcctatatcacagagcattggaggtctgccgtcatggctaatgtaaaaaagcggctggatgtcctgctggtggaacgaggtctggctgaaagccggcagcgggcccaggcggtgatcatgagcggtcaagtctatgtcagggaacaaaaggtggacaaggccgggacgcaggttgaggagaacgccccgattgaggtgcgtggacaggcgttggcctatgtgagccggggcgggctgaagctggagaaagccctcaagactttttccggcatccgcttaaagggagtacatgccattgatgccggggcgtccaccggcggctttaccgactgtatgctccaaaatggggcggaaaaggtgtatgcagtggatgtgggctatggacagttggcctggagcctgcgcagtgatcccagggtggtgtgcatggagcggaccaacgtgcgctatttgacggcggagcagattccagagccgctggacttcggtacagtggatgtgtcctttatctccttaaagctgattttacccgccctacggggtatcctaaagccggacggacaggtagtctgtctggtgaagccccagtttgaggcgggccgtgagaaggtgggcaagaagggggttgtgcgggaccccgctgtccatctggaggtgctgcggcagtttttgcagaacgctcatgaggcggactttactgtaaaggaaatgaccttttcgcccattcgaggaccggagggcaacatcgaatatttgggacacctgtgtgtcggggcgggcgagccctggaacggcgacctttcagctctggtcgaggcatcgcacggggcattggagggaaccggacaatgaaagtggtattgagcccaaacccataccgggaccggggcctgcgggcggcccaggccgcggaaaagattctgcggaacgtgggggtggagaccgccatgtgtctgcccttcctcctggagggcagcaatctggaatttcccaagcatatccagtttaaggacacccaggaggagctgaaaaacgcggacatgctggtttgcttcggaggagacggaaccatcctccacgcggccaaggacgccaacgcccacaaggtgcctatactgggggtcaatctgggcagcgtgggttttatggccgagctggagcagagcgagctgtccatgctgtccaagctggcggccgggaagtacacgatcgaatcccgtatgatgttggatgtagcggtccgccgggatggaaaggtgctgttcaatgacatcgccctgaacgacgcagccctcacgaaaggggctgtggcccgggtcgtggatctggaggtatatggcgacaaggtgatgatcgccaatttttccgctgacggcgtgattgtaagtacgcccaccggctctacagcctattccatgtcggcgggcggccccatcgtggagcctacggcggagaatatgattgtgacgcccatctgtccccatgccctctccgcccggtccatcgtcttgggacgggagcgtacggtgtccattaaaatggggaagcagtcacgcaagactgcctatttgtcggtagatggcggcaaggcgtttcgtctgggcagcggcgatgtggtggagctgaagatgtccagctccaagacccgtctggtacgggtgacagggcggagcttttatgatatactaagtcagaaactgggaggtgccaaggcgtgaagggaaaacgtcagcaggagattttgcgcattattgaggaacaggatattgatacacaggatcagcttctggcggagctgagggcccgcggactccaatctacccaagcgaccatttcccgggacatcaaagagttgcatctgatcaaggagcttaccggctacgggacctaccgctacgcggtgtcagagcgcaaggcgtcgctgaatgtcgccagccggctgcgcacgattttcaaggagggggtcatctcctttgatctggcccagaacatcattgtgctcaagaccatgccgggagtggcatcggcggcctgcgcagccattgacggcatggagatcacaggactggtgggcagtcttgcgggggacgataccgcgatgctggtcatgcgcaccaacgaggacgcgcaggagttctgcaacgagatccacacaatgctgaaataaagcggaaacggcggggtggtcggcatgctctcactgttgcacattgagaatatcgcagttatcgaatcggcggacattcagttcgacaagggattcaacgctctgacgggggaaacgggagccggcaagtccattgtagtggatgccatcggcgccatcatcggagagcggaccagccgggatctgattcggacaggggccagatccgccctcgtcaatgccgtctttaccggcctgcctccgctggcctggttccaggagaacggcggagggccggacgaggatggaaatctgctgatccagcgggagatccagccggacggcaagaatgtgtgccgcctgaacggacggctgattaccgtagctcagctacggcaactgggccggcagctcctcaatatccacgggcagcacgacggccagcaactcctggatgagcggtgccacctggagtatctggatggattcggagaaacgggatcgctgcaggaggaataccgggcggcctttggccgctttgccgtcctgcgccgggagattgcggctctccagatggacgaggcggagaaggcccggcgcatcgacggcctggaattccagatcaccgagctggagcgggccggactgaaggccggggaggaggaggtcctcaccgagcgccgcaatttgctgcgcaatgcgggcaagctgattgaggcggtggagggcgcccatttggccctctcaggcgatgaggagcgtgagggggccgccggcctgatcggcgcggcagagagttcactccacgcggcagcccggctgagcgggcaggtggcggagctggtggacaggctgacggagctgcgctgctcggccgatgatctggccgagcaggtgcgggatttacgggatggtttcgactttgaacccggtgagctggacgagctggagagtcgtctggatgtgatctaccggctgaaaaagaagtacggggactccgtggaggagatgctggactacttggagcggtgcagaaaggagctggacgagattcagttctccagcgataccatcgcccggttggaaagggatctgggcaaagcgatggaggaggtccggcggcggggtgaggcgctgagccgggcgcgccgtgaagcggccaaggcgctggaggagcgtattcaaacggaattggcccaactggacatgccgaaagtgcggttccaggtggagttccggcccaaagcgggggagtacgccatggacgaaaccggactggacgaggtgcagttccttatgtccgccaatgtaggggaggatctgaagcccatccagaagatcgcctccggcggtgagctggcccgcatcatgctggccctcaagaatgtgctggcggagaatgatcaggtgggcgcactggtttttgacgaggtggacaccggtgtgtccggccgggcagcccagaaggtggcggagaagttggcgggcgtggcccgcaccaagcaggtgctctgcgtcacccacttgccccagcttgcggccatggcggacgtccatttctctgtggagaagggggagcgcaaggggagaaccttcacagaagtagagcgcctgagccgggagcggcgcatggaggagctggcacggctgacctctggtgagcgcatcaccggcgcgacactggcggcggcgggggaactgctggacagtgcggaacggttcaagcgggctttaacccaacaaaagtaatcttttgttgagttaaatcttccccttgacaaactggctgccccgtactataatccaactcaatatgagactgcgatgacagggagaagtaccgtcttatgtcccgcccagagagcccccgtcttggtgtgagggggaggggacaggccgggaaatacaccctggagcagccgcccgaaccgcgtgaaggcgcgcagtaggggtgtgtcgggtgcgcccgttaccgcgccggagtgtgttggcactccatgaggctgtctccgtgaggggatggtgaaccagaggtggtaccgcgtttgacaacgccctctgtccgtgaggacagggggcgttttttatattaaaacacaaagtgcagccatactaattagcaattactgtaggggcgtccctatggacgaaagaaaaggagaatgaaactatgacctgttacgaagaactgaaggcccgtggcctcattgcccaggtaaccaatgaggaagagatctccaagatgatcaacgagggtaaggcggtgttctatatcggcttcgaccccaccgccgattccctccacgtgggccacttcatggccctttgcctgatgaagcggctccagatggcgggcaaccggcccatcgccctcatcggaggcggtaccggtatggtgggtgacccctccggccgcaccgacatgcgctccatgatgacggtggagaccatacagcacaactgcgcctgcttcaagaagcagatggagcgttttatcgagttcggtgacggcaaggcccagatggtgaacaacgccgactggctgatggacctgaactatgtggagctgctccgcgaggtgggcgcctgcttcagcgtgaacaacatgctgcgggccgagtgttataagcagcgcatggagaaggggctgagctttctggagttcaactacatgatcatgcagtcctacgatttctaccacctgttccagcactacggatgcaacatgcagttcggcggtgatgaccagtggtccaacatgctgggcggcaccgagctcatccgccgcaagctgggcaaggatgcccacgccatgaccattaccctgctgctcaactccgaggggaagaagatgggcaagaccgccaagggcgcggtgtggctggatcccaacaagaccagtccctatgagttctaccagtactggcgcaacgtgggcgacagcgatgtgctcaagtgcctgcgtatgctcaccttccttcccattgagcagatcgacgagatggacaagtgggagggcgcccagctcaatcaagccaaggagatcctggcctttgagctgaccaagctggttcacggcgaggaggaggcgcagaaggcccaggacgcggccaaggccctgttcgcccagggaggcgacaagtccaacgtgcccaccaccaccctggacaccggcgatctgactgacggggcgatcggggtgctggagctgatgctcaagtgcggcctggtgccctccaagaaggaggctcgccgcctggtggagcagggaggggtggagttggacggtcagaaggtcaccgatgtggccgcagccgtgaccgccgaacagctctccggcgagggtataatgctcaaaaagggaaaaaaggtcttccaccgtgcggtgctcggtgaatgaaaaaaggcgccggaggataattcccctccggcgccctttttcggttgcggaagtgattggatcatgatacaatcttaacaggatagccaatacggaaggggattgcggcatggaggataaggacaagcaaggggaaaagaaatggtatattctggatcggggatcgttatctctcctgatcgtcctgttggccgctatcctgttttatgtgggattgaccaatttcgatgttatcgcggtccgggtgcgcacatttatgggtgtgctgacgccctttattgcaggttttgctatcgcctatctgctcaatacgcccatgtgcttttttgagcgaaagctctaccaaaagcagaagcaccggcgtgggctggcgattctgacggtctatctgatcgccctggcgatcgttgtggtcctgctcaacctgatcataccgcaggtggcgcaaagcgtggtagatctggccaccaacatgcagacctatctgaccagcctgaacagcctggtgcagaccctctccgagcagtttggactggaggcggaggccctgaatgaggctattggctcttatcaggacctgatgaccaatattgccgcctatctctccaaggctctgccggatctgctgaactttggctacgccatcggcagtggggtgatctcgggcattaccgcactgatctcctcggtttacatgctggcagggaaggggcggctggttccgcagatcaagaagatgctctacgccattctgcccaggcggcgggcggactggcttctcggggtatgcggacatgccaaccgggtatttgtaggctttatcaatggcaagctgatcgactcggccatcatcggtgtgctctgctttatcctttgcttgattttccgcatcccatatcccatgctggtcagcgtcgtggtgggcgtcaccaacattatccccttttttggaccgatcatcggcgccatcccctgtctgatgattctggtgatcgtcgacccttgggcggccctgcggttctttgccttggtcatcggccttcagcagtttgacggcaacatcctcggccccaagatcttgggcgacagcacgggcctgtcagccatctgggtgctggtttccattgtggtgtgcggcggcctgtttgggttcccgggtatggtactgggtgtgcccacctttgccgtgctgtatgcactggtgcgggactgggtcaacaaacgcttggcactcaagcgcctggacggaaacgggaggcctctggacggcgctccttaaaaactgaacgagtagagtagtgaagggaggtgcgaagcgaagcttcgcacctcccttttagaggcccaaataggtcaccaagtccgccatggagtatagaccgggggactgcccggcagccagaaaccgggcggcctgaaccgctccggaggcaaacacctcgcggctcagggcggagtgccgcagctcaatgagctcatcccgcccggcaaagagcacctcatggtcgcccacaattccaccgccccgcaccgaggagatgccgatttcacagcgctcccggctccgccggataccctgccgaccgcagaccagctccggttggcaagggagggcgtccgccgcggcctctgccagcatgagggccgtcccactgggggcatccatcttcttgttgtggtgccgctccacgatttcgatgtcacagctcccgcccagcaccgctgcggtccggcgtaccaactcgacgaggatgtttacgccaagggacaggttggcggagcgaaagatagggatggaacgggcagcctgctgtatctcctccagttgtccctggtcatagccggtggtggccagcacaaggggcatcctgtgttccaggccgaagctcagcagagcgggaagggccgagggactggagaagtccaccacaacgtcggcttctccctgaaattcggcgggggaggcgtataccgggaaatcgcggatatccgcgcccagcagatcaaagccggcggtcagctccagctccggttcagcggcacagatagcctctaccgcatggcccatccggccgttacagccggagaggagcagttgaaccatagttcacatcctttctctgcgctattggagcaggtgagcgctctccatggcgcggcgcagggtctccaggtgcccgtcggacatggcgcaaagggggaggcgcagggaacccacctcatagccggccagattcagggcggtcttgatgggaatggggttgacctccagaaagagggcgtcaatgaggtcggtgtacttgatctggagcgcagcggcctcccggaaccggccctccaggcagaggtggctcatctgaaccatcacctcagggacgagattggccgccacggagacgacccccttggcccccagactcatcatgggcaccacctgatcgtcgttgcccgaccagatgtggaagtcatcgccgcagagggcgcgggtgtgggagagcagggagaagtttccgctggcctccttgaccccgttgatgttggggtgctgcgagagaagctggtaggtctcggcggtaaaggatacgccggtgcgggaggggacattgtagagaaggatgggcagctccacccggtcggctatgtaggtgtagtgctgaatgaggccggtctgggacgctttgttgtagtagggggtgacgagcagcagggcgtccgcgccggagtcctgggcgtgctgggagaggtagagggcagcggaggtgtcgttgctccccgcgccggcaatgaccttcacccggtggttaacccgcttgacgcagaaggccacggcggcgatgtgctcccggatagagagggtggcgctctcgccggtggttccgcagacgcagatggcatccacgccgtggtcgagctgctggtcgatcaggcggccgaagcagccgtaatcaatggcgccgctctggtcaaagggggtgacaatggcggtacaggctccggtgaaaacaggctctcgcataagatggggtttacctcctttggatatacccctccgcgcagagaagctcagcaaggagaaccgcaccgccggccgcgccgcggagggtgttgtgggacagacagacgaacttgtagtcgtactgggtgtcgggacgcagccggccgatgcacacggccatgccgccctcggtcatccggtccagccgggtctgggggcggtcaggctcctcaaagtagtgcaggaactgcttgggggcagagggcagggccagctcctgggcacggccctggaagcccgcccaggcggctttgatttcgtccagagagggcttgttccggaaccgggcgaaaacggctgccatgtggccgttggaggcgggaacgcggagacactgggcggtgatggacgggcctgcggcattgacgataacgccgtcctccacccggccccacagcttcaggggctcctgctcgctcttttcctcctcaccaccgatgtagggtatcacgttgtccaccatctccggccaggtttcgaaggtcttgcccgcaccggagatggcctgataggtgcagaccagcacctgctccaggccgaaggcgcgcaggggatggagggcggggacatagctttgcagggaacagttggacttgacggcgataaagccgcgctccgttcccagacgcctgcgctgggcttcgatgacccggaggtgctcgggattgatctccggcaccaccatgggcacgtcgggcgtccagcggtgggcggagttattggagaccacggggcacccgcggcgggcataagcctcctccagggcctgaatttcctccttcttcatgtccaccgcggagaatacgaagtccacctgggcggcaatccggtcgatgtctgtttccgcgttgagcaccaccatgtccttggcctccccgggcatggggacatccagggcccagcggccaccaatggcctcctcgtaggtcttgcccgcagagcggctgctggccgcgatggcggtcaactgaaaccaggggtggttctccagaagggtaacgaagcgctgaccgaccatgccggtgccgccgatgacgccaactctgtacttttccataaccaatacctccgtcgttccataatatcctattccagatccagcttgtttgagactgggaaaatgaggactttcatataaaaagaaaatcagcagtttacatgtccgctgattttgtactataatgtcaaagacgataccgctacggcgcagtccaacttaggtgcagggcgctccctgtcgtttttgaaaccgccacggctcctatcctgcatctgatactgattagttttcaaagattgtaccacagatggagcccatgtgtcaatgaaagagagttgaaaagtgattcaatgaagcagagggtaaaaggaaatattttgcggcttgtaactgcctgtcttgcaattttattgataagtgggcttgctccggctggtgcggcctcggcggaggccaacccgatggtccgggtgggcctgttctacggcggaaacgccctgtcgggggccaacctggccaacgacgtgggcagcggctaccgcttcggctactttgacggcgatctgaccttccagctcctgggctacaccagtgagacgacggtttccatggtgaaaacccagaatgtgtactacgggtcgaatgtggactggagcggctccggctattacgacagcaagacctccgacatcgccgtggggtgttaccatctccagctcccccagacctacgccacctttgaggaggcatcggccgccgcggcacagtacagcgatggcttcccggcgtggattgacgggcgctactatgtgcgggtgggagcctacctggacagtacctccgctcaggcggcccaggcctccctcggcctgaccggggccacggtggcgggcacctcgggggcggggatctctgtggtaaagacgggcaccaatacggtcctctttcagtttgacagcacctccggcctgtatctggcggttaagcccggtcgggacgacacggtgaaggcggaaacctacttccggggctattcctatttcggggcgtttgaataccgccggaacggcggggacatcacggtggtcaatgtgctttccatggacgactatcttcagggcgtcatcgtccaggagatgagcccctcatggcccctggaggcattgaaagcccagacggtttgcgcccgcagctacgcctatggaaagctccaggcgggcaagcaccagagccagggcttcgacctgtgcaacaccactgactgtcaggcctacgtgggtatcgctaacgccagcgacaacagccgccgggcggtggaggagaccagcggggtgtatctgtggtacaacgggcgggtggcggaccagacggtttactcctcccacaacggcggagccagcgagagcgccgtcaacgtgtgggggagggattacccctatctcatcgggaagattgacccctatgaggcctccgtcgtggaccgtatctccaactacaactggacggtgacctataccgcccaagagcttaccgagctgctccagagcaaaggctatggaaacagcaccatcgtggatttccgggtgaccaagaccagtcccaccggaaatgccatcgagatcaccttcaccgatgccaacggccggagctggagcaagacgcgggaggcgtgccgcaccttcctggggctgcgttcccagcactacaccatatcgggcggcagcggaggaggctacgcggtcaatggcaccggttccctcagtacactgaacggagcctatgccgtggatgggagtagggcagtgagcacactgactgaggggcaggtctatgccatcggcggggacggcgtcatctctcaggtgaagccctccgcgtcggccggcagctccggcgtctttaccatcactggatccggctgggggcacggagtgggcatgagccagtggggtgcctattccatggcccagcagggtgatacttacaaggatattctgaccttttactatactggaatcgaggtgcgcaagccataaaaaccgctgattttgatttttatctgccggaggagctgattgctcagaccccgctggagcggcgggacgcctcccggctgctggtgctggacaaggagaccggagccacccggcacatgcatttttttgatctgcctaccctcctgcgcccgggggactgcctggtgctcaacgactcgcgggtgctgcccgcccggctgttgggccatcgggagcccaccggcggcgcggtggaggtgctgctgctcatcgaccggggggacaaggtgtgggagtgcctggtgcgccccggccgcaagctgaagccggggacgcggctgtccttcggggacggctccctcaaggccgaggtggtggaggtatgcgaggggggcaaccggctggtccgcttcgagtatgaggggatcttcctggagaccctggagcggctgggcaagatgcccctgccgccctacatcaaggcggagctgagcgaccccgagcggtaccagactgtctactcccgcgaggtcggctccgccgcggcacccaccgccggactccactttacccgtgccctgctggagcaggtgcaggaaatgggggtaaaggtctgctatgtgacgctccatgtgggcctgggcaccttccgtccggtgaaggaggaggagatcaccgaccacgagatgcacagcgaatactgcatgatctccgccgagaccgccgagaccatcaaccgtaccaagcgggaaggggggcgggtcatctgtgtgggtaccacctcttgccgcaccatcgagagctgggcagcggaggacggcacgttgaaggagtgcgcggggtggacgaatatcttcatctatcccggctaccgcttcaaggcgctggactgtcttatcaccaattttcacctgcccgaatccacgcttatcatgctggtttccgccctggcagggcgggagcatgtcctggccgcctataaggaggcggtggagcagcgctatcggtttttctcctttggagatgcgatgttcatcggctgagtcagaacgaaaaagagaaaccggggttcccacaagttgtgggaaccccggtttttgtatgggtcagataaggccctcttccaccagaaagtcatgggcgacatcggcggcgtttctgccctcgaggtctacctcggcgttcatggcggccattgcctcattggagatgcgaccgtccagcagggcgagcacctccttcagctcggggtactcgtccagacactcctgacggataaagttgaccgcgtagtagggcgggaagaagctggcgtcatcctccagctgaaccaggtcaaacttggagaggagggcgtcggtggcgaaggcgtcgataacatccacctggccgctgtcgatggcggtatagcgcaccgccacgtccaaagcgttgacctcgccgaacttggtatggaaggtggactccaggcggggaagggcatcctcccgctgggtgaagtcggcggtacagcccagacggagttcgggtgctacggccatcagatcggtgagggtttcgagctgatactgctcggcgatctccggccggacgctcatggcataagtgttgttgtaacccaggggggcggagacggagatgttgtagtcgtcccgcattttctccgacaggatctcatagacttcgtcggtgttggtgttcagaggcagtcccaggacagagaggtacacctgtccagagtagtccaccaccatgtcgatgtcgccgttctccatggcggtcatctccagggaggtgctggccaggccgaaggtggtgtccacctggatgtcggtcttggcctcgatgagctccttgtagatgttgccaacgatgtagacctcggtgaagttggaggcgccgacggtcaggtgcttgtcagacttcttgttgaccaggtttccgccaatggcgaccaccaccagggcgacacacacgcccacggcgatcacctgccggcggcggatgaccttcttgggcagattctggatctgctcgttgggaagcaggccctcactggtgaccgcctgctccagcttggcgaagatgaaatcaaagagcagcgccagcagggaaaccgggacggcgcccagcaggatcatctccacattcagggagttgaggcccagattgataaaccagcccagacccttggcgccggcgaaggcggcgatggtcatagtgcccacagaggccacggcggcgatgcggataccggccatgatgaagggggcggcgatgggcagctccaccaggaacaggcagcgcgtgcgcgtcaagcccatgccccgggctacctccaggttcttggggtccacgctcatgatgccggtataggtattcttcagaatggggaggaaggcatacacaaagaccatcaggatggcgggcaccgtgccgatgcccagaaagcagacggccagggacagcagggcgatggaggggatggattgcatgacgttggcgatgccaatgacgattttggccgctgtctggttgcgggtgataaggatgcccagcggcacaccgatggccagggagatgagcagggccagtgtggtcatgttgatgtggcggaaaagctcggtgaccagttcgggccagcgggagaccaggagctcccagaaggaggacagagagaatgaaatgcccataattacgcaccctcctgttcgtcgcgctcaaccggctcgtcgatgaaacggcggctcagggtggagaggaggctgctccggttcaggaaaccgcgaatggctccctccgcatccaggacgggcaggatgccgaagtccttctcgccatagtccgctaccttttccagtacagtgctcaggctgtcgtccacccggacggacagataatcgtcagagaggaacgaggagaccggggagctgtattggtcgatgccgatcagatcctggagccacaccataccggcaaacttattgtcgtcgccggtgaccagcaggctgtcgatgttatagtgccgcatgagctgtaccgcctgcaccactgtgcggctctgagagatggtgatggggcgggggcgcatgatgtcctcggcccggataaaggaggggttctcccacaggcggttcttgccgatgaaggagttgatgtactcgttggcgggatgcttgaggatgttctccggcttgtcgcactggaccacatggccgttttgcaggatgcagatgcggtcggccagcttgacggcctcatccatgtcgtgagtgacgaaaacaatggtcttgtggaaccggagctggagccggtgcacctcgtcctggagctcggcgcgggtcatggggtccagggcggagaagggctcatccatgaggatgatctccgggtcggcggcaaaggcgcgggctacgccgatgcgctgccgctggcctccggagagctgggaggggtactggctgcggtattggtccggctccaggttgaccagctccagcagctcggtgatccggtcgtagattttttccttggggtacccggccacacgcatggccagagcgatgttgtcctccaccgtcatatgggggaacaggccgccctcctggacgacatagcccatcaggcggggaagctgggtcaccttgatccggttgatgggggtgccattgatgagaatctcgcctttgtcaatggggttgagcttgttgagcgttttcaacagggtcgttttcccgcatccgctggaaccgatcaggacaaaaaactcgttgtcctggatggtcagactgatgttcatcagtaccgattttccgcggtatgacttgtagagatttttcaattcaatcacagcaaaggagctcctttctgaatgatccctattgtagtatggagtggattgaaatggagtaaggattgacggatttagataaagaatttgttaaggcagggagaattcgcttgacagatcattctgtatctgctaaagttacagtacaaactgtaactaaaaaaattacaaataagtatgagtggaagccgcaaaggcttggaaccctatctccagtagaaaagaaaagggcaaacagaaaggatgaatgtaatggaagcgatcgtcatcacgaaagaaaattttgaggagcaggtgctgagggcggagaagccggttctggtggacttctgggcgccctggtgcacctattgccggcgtattgcccctgcggtggaccaggtggctggacagtatggggagcagatggtggtcggcaaggtgaatgtggacgagcagccggagctggcagagcggtttggggtggagaccatccccacgctgctggtatttcggaatggacaggcgggagagccgctgatcgcccccggctcaaaggcgcagattgtagagtgggccggactgtaagagaggaggtgcgccggatgggtgtaaagcactatgacgtgattgtgatcggcggcggacccggcggctatacggcggccctgtactgtgcccggagcgggcgctcggtggcggtgctggaaaagctctccgccggaggccagatggcgaccacggaccggattgacaattatcccggctttgaggagggcattgacggcttcgagctgggagagcggatggagcgccaggcctggcggttcggcgtgtccacggtatacggcgaggtgcgctcggtggagctggcgggccggcccaagcggatcgagagtaccgagggcagctttgaggccgaggcggtgatcctggccacgggggcgttcccgcgtgagctgggcctgccggacgagcaggcgctccgcgggcgcggggtggcgtactgcgccgcctgcgacggcatgctctaccgcggcaagacggtagtggtcaacggaggcggaaacaccgctgtgggcgacgcgctctatctggccaagctttgtaaaaaggtctatctggtccaccggagagacgagctgagggcctcggcggtctatcgggacgcgctgagggaaaacggcgttgagatcctttggaacagccgcattaccgctctgcgcaaggagaaacgcctgacaggtgttgaggtggaggatcttcgcaccggcgcacggcgggagctgttctgcgacggcctgtttgtggccatcggccgggtgccggatacggccctgtttgccggccaggtggagctggacccctcgggctatatcgtggcggatgaaaccacccgcaccagcgtgcccggcgtctttgcggtgggcgatgcccgcactaaggcggtgcgccagatcgtcaccgcagtggcagacggggccgtggcggcccactatgcggaggagttcctgttggaggatgctgtaaaggataaaaacctgtcatgaatagtgcgttttgtgtggcggtccacgccctgatctgcctgaaccggcggcaggagcagctctccagtgaggagctggcccgcagtatctgtaccaatccggcccgcgtgcggaagatcatggcggggctgaagcgggccggactggtggaaaccaaggaggggaatgagggtggctaccgctttgtgggcgatcccgccgcccttacattagatcaggtagcccgggcgctagaggtgcggttcgtgtcgaccaactggcgcggcgggggcgtggatcagccctgcctggaggcatcgggtatgttggaggtcatggacggtctgctggaggagctggaccagggctgccggagcaggctttcggagatcagcctggctgagctggacagcagactttatttgaaacaaaggagatgaatatgggtctttcactggagacgagcgtgccggtacttacggtgtttttacaggggctgctgagctttttctctccctgtgtgctgccccttgtgcccctctacgtcagctatctggcgggaggcgccagggacgtggacagcgacggcaatatccgctatcccaggggaagggtactggtcaacaccctgttctttgtggtgggcatcagctttacctttttcctgctggggttcggctttacagcactgggaagctttttccgcagcaaccagacctggtttgcccgcatcagcggcatcattatgatcctgtttggcctgtaccaattcggcgtgttcgggcgctcgggcgccctggagcgggagcaccggctgcccttccggctggaccggtgggctatgaacccgctggtggccctggtgcttggctttaccttcagctttgcgtggacgccctgcgtgggccccacgctgggcagcgttttgctgatggcctcttcggcgggcagcgccgcccgcggcttcctgctgattgcggtatacaccctcggctttgtgatccccttcctggccgtgggactgtttaccggggcggtgctgggctttttcaagcgccaccagagggtggtacgctacactgtgaaggtgggcgcggtcctgctggtgcttatgggcatcatgacactgactggcttcatgaacggcattaccagttacctgtccagcgcggcgggcagcggagcggccgaaacgccccaggctcagacaagcggaactccggaccccacaccagaggggagcgtgcccgccggaccggaggagagcccggcggccagcgggcggccggtgattcccgcgccggatttcaccctggtggaccagtacggggaggagcataccctctccgactatgagggcaagacggtgtttctcaacttctgggcgacctggtgcggtccctgcaagcgcgagatgccggaggtgcaggcgctctacgagaaatacgggaacaacgagggagatgtgatcgttctgggcgtggccaatccaaagtcggaggagtacccctataatcaggatgttactcagccggaggtggagcagttcctggaggacggcggctacaccttcccggtggtgatggacgttacaggagaggtattctactcctacggcatttccgcctttcccaccaccttcatgatcggcgcggatgggaatgtgttcggctatgtgccgggagctctcaccggcgatatgatggagtccattgtccagcagaccatagacggcgttgaggcgggagcatgagggatactcttgtcaaagctcagtccttctggtattatgaaaggtaagtttttgacaaaggagttttgacgtgtttgaagtcctgaaaacagagggaaaggcccgccggggtgtctttacctgcgcccacggcacggtgcagacgccggtgttcatgaacgtgggcacccagggggccatcaagggtgcggtgtcggcccacgatctgaaggagatcggctgtcaggtagagctgtccaacacctaccaccttcacctgcgccccggcgaccaagtggtgcggcagatgggcggcctgcacaggttcatgcggtgggacggcccgatcctgaccgactcgggcgggttccaggtgttctccctgtcgggcctgcgcaagatcaaggaggaaggggtcaccttcgcctcccacatcgacgggcgccgcatctttatggggccggaggagtccatgcagattcagtccaacctgggctctgatatcgccatggccttcgacgagtgcgtggaaaacccggcgacctatgagtatgccaaagcctcctgcgagcgcaccctgcgctggctggcccggtgcaaggcggagcacgaccggctcaacgccctgcctgatacggtgaatccccgccagatgctcttcggcatcaatcagggcgccactttcccggagctgcgcatctggcacatgaaggaaaccgccaagattgactgcgagggctacgccatcggcggcctggcggtgggggagcccacccaggtgatgtatgacatcatcgacgcggtggagccctatatgccggcggagaagccccgctacctcatgggggtgggtaccccctccaacatcatcgagggtgtggcccggggcgtggacttcttcgactgcgtgatgcctgcccgcaatgcccgccacgccaagctcttcacctggtcgggggcgctgaatatccgcaatgagaagtacaagctggacgagcggcccatcgacccggactgcgactgcccggtgtgccgctccttctcccgggcctatctgcgccacctctttgcagcggaggagatgctggccatgcgtctggcggtgcttcacaacctctatttctacaacaaactggccgaacgtatccgccaggcgctggacgcgggccaattcgcggcattccgggcggagtattccgagaaattggccgggcggctgtgaagtttctgtgaatgaggcgaaaagggcttgtcaaaatctgcttttcgctttataatgtcctattggtgacgttttaacgtcaaagtatgaatcggaggggattattttgctgacacagactgctggcgttctgctgacaaattcagggacgaatggtagtgcaagcttattgagcatgcttctgccgttcgtgatcctgatcgcggtcttctatttcctgctcatccggccggagaacaagaagaaaaaggcggcggccaagatgcgctctgagctggcggtgggcgatgagatcaccaccatcggcggcgtggtaggcaccatctgccaggtgaaggaggataccatcatcatcgagaccagcgccgaccgtgtgcgtatggagttcaccaagtgggccatctccaccaagggcacccagtccacggagaacgctcctgcggacaccaaggattccaaggacaagaagtaatagtgaacgccctccctgcataggtttcagtaggaatccatgccaagggagggtgtttttatgaaaaaaaaggaggaggagcagagcgcaaagctgatccgctgcggaatggggctggtgctggggggcgtggccgcgctggcggtttgctttgtctttctgctggtggcgtcggcggccatttccggcggactggcaggggaggagctgatgtatcagctcaccatcgtgggatgtgtgctgggggcctttgcgggcggcctgctggcagtgcggcgctgtgggagccgggcgctgatcgttggccttaccaccggcggagtgctcttcctgctgctgcttaccatcggggcgctctgcttcgaaacggtctctctggaggcggggggcatcggcctgctgtgcggctccctgtgcggcggagctgccgccggaatcctgggcggcgggggtaagaagaagcctgcccggaaaaaacgcagaaaataattgaaatcgggcggagaatgtgttataatcgctccaaaccatcgttatgggagggaaaccagaatgaagcatgtgaagacgctcaacggcgcgactctgaagaagagcgccgcccacggcggctgcggcgagtgccagacctcctgccagtccgcctgtaagacctcttgcaccgttgccaaccagaagtgcgagaaccagtaaaaacgaacttggctcgaaaagggtggggcatcccaccctttttgtatgccgtaataaagtgaggaacgaacaaatatggtacatacctttcaatgccttggcgtgaatatcgccgtggatgtcaacagcggcgccgtccacgtgctggacgagctcacctaccaccttctggagcaggtgcagccccccatgggagagcactgcccggcggagctttgcgccaggctgccccagtacgacccagccgccctggaggaggcctggcaggagctgcgcggtctggcggccgaggggctgctttttgaggaggacgactacattgaccgggagaaggctgcctccatgcagcagcaggccctggtgaaggccctgtgcctccatgtctcccacgactgtaacctgcggtgtaagtattgctttgcctccaccggcgatttcggcactggccaccgcatgaccatggacttcgagaccgccaaacgggccatcgacttcgtcatcgccaagtcgggccaccgccgtaacatcgaggtggacttcttcggcggcgagccgctgatggccatggataccgtaaagaagacggtggagtacgcccgttccattgaggaggagcacgacaagtgcttccgctttacaattacaactaatggtgtgctcctcaatgatgagaacatcgagtacatcaaccgtgagatgtccaacgcagtcctgtccatcgacgggcgaaaggaggtcaacgacgacctccggcccacagtcaacggcaagggcagctatgacgtgattgtgcccaagttccagaagctcattgagggccgtgggacgaaggactactacctccggggcacctttacacgattccatcaggactttgccgaggacgtgaaggcgttggcatccatcggacggaatatctcggtggagccggtggtggggaaggaggacgacccctacgccctccaggaggcggatctgcccgccctgaaggcggagtacgagcgcctggcggagtatctcagggaccacccggaaaccaacttcttccatttcaatgtggatctggcccagggcccctgcgtgatcaagcgactgcggggctgcggcgcggggtgcgaatacgtggccatcaccccggagggggatatctatccctgccaccagtttgtgggcaatgaggactacaagctgggcagtctctacgacggcacctttgacaaagagctgtccggccgcttcgccgggctgaacatctacacccgggaggagtgcagggactgctgggcgcggttctactgctcgggtgggtgcagcgcgtccaacctgcttgtcaatggcgacataaaaaagccccaccgtgtgggctgtgagttggagcgaaagcggctggagtgtgccatcgctctgcgggcgatcgcggccggaatggcggagtgacatatacagatcgtaattatacaaatcgtaatctctgctacaaacagacaaaaagtgatgaattgagccggatgtcggcaaaaacagtgactataattttagtaaagaggagcgccgcaaagtgcggcgctcctctttttgtgcgcgtagtttacataatgaagtaaacataacaacttggcataatatacaaaaatgaagttttttcttttccgtccttgcacaagacggcctggtaagctatagttagcatgtaaaccgttggcacgcgtctaatcgaggccctgtccgcatatgctcccatgggaggtgagggcgatgcgcagggcggcggaagcgtggagaatttcaggggatgggcttattccggtgctggcggtaactgcggcctgctttttgttgggcgggctggtaggatgcctgctggcatcccatatcggaggcgggggtcaggagagcctggccgcctacgtggagggatttcttcgcgccgctcaggcgggggagattacagcgcctgcgctggcctcattggtgtgggacaccgtgcgctggccgttgctggcgctgctgctgggcttcaccgcgctggggcttctcgggctgccacttctgtttgcggtacggggatttctgctggccttttcgattgcctcatttgtgcgcctgttcggcggcgtgggctgtctgctggcccttttggtctttggggtgagcggtgcgctttcggtgccggtgctgtttgtgcttggggtgcagggcctcctggccgcccgggtgctggccggacgggtctggggggatgggaaaacccctccgccctatggaaaactctattttttccgctgcggcgcctgtgccgtcgcgctgtgtgtgagtctgctgctggactgctttgtagtgcccggcctggtgtccagcctggcggggacgttcctgagcctatagagatactgcgagaaggtgttggacggatggattatcaatcaggttatgcgcactatttgacagaggaaaagcgggcctccgccaacacgttgagctcctatctgcgggatgtgacccagtatctccactggctggaaggggagggggttccgccggagcaggccgcacagaaggatgtggagtcttatacgagatttttgtcggccaagggtaagtcggcggccacggtaacccggtcgctggcctctctgaagtctttctacagctatctgatcgcggagggcagggtgtccgtcaatccggccagggggctggccccggcgaaggtagagcggaagctgccccacatccttacctccaaggaggtggaactctttctggagcagccggatgcctcggatgccaagggctgccgcgatcgggccatgctggagctgctttatgccacgggtatccgtgtctctgaactgattggtctggatctggaaaatgtcaacctgtccgccggctttatccgctgttccggccggggaaaggagcggatgatccccctctacccggcggctgtccgggcgcttcaggactacatagagcacgtgcggccccagatgctggagcacccgcaggaacgcgccctgttcgtgaatatgagcggggagcgcatgagtcgccagggcttttggaagatcatcaagcactatcaggagaaggccggaattcagacagaaatcacccctcacaccctgcgccactcctttgccgcccatctgctggaaaacggcgcggatctccactccatccaggagatgctgggacacgcggacatttcgtccacccagatctatgcccagttggtcaaccagaagctgaaggatgtctacaacaaagcccacccgagagcctgactgacgggccgcggcgcgctgcgccgcggcccgtttttcggcttgcgccgccgtgcccgccgtggtaaaataaatttcgtatggactcaggaggggaacggataccatgctgattttaggcatagaccccggctttgccattgtgggctttgggctggtggaggccgatcgtggccgtcagcgcctggtgcagtgcggcgcaattaccacaccggcaggggagcccctgcccgcacgtctgcggcagatcgccgacgatatggacctgttgctggcccaattccagccccaggccatggcagtggaggagctgtttttcaacaacaatattactacgggcatcggcgtggcccaggccaggggagttctcctgctggcggcggagcgccggggggtgcccatctttgagtatacccccagccaggtcaagcaggcggtggtgggctacggaaaggcggagaagcggcaggtcatggatatgacccgccgtctgctgaatttgagcgccgttcctaagccggacgacgccgccgacgcggtggccatcgccctgtgccacgcccgctcgtttacctcccgccttcagagccccgacgcggcccgcccgggcagcgggcgctatgaggtgcggaaacaagtgcgttaggagaagcaaaaacaatgttttattatctgaacggcgtggtggctcacatggccccctttctggcggtcatcgactgcggcggggtgggctatgcctgccgcaccaccaacaacaccctgtcccatctgcaaaaggggaagccggccaagctctatacccacctgaatgtccgtgaggacgccatggagctgttcggcttttccacggagaatgagctcaactgcttccagctcctcacctcggtgtccggtgttgggcccaaggctgcgctctccatcctgtctgcggccacacccgagtccctggccatgagcatcatcaccggggacgaaaaggccctgacggtggcccagggcatcgggaaaaaaatcgcccagcgcatcatcctggagctgaaagacaagctggccaagggacagatcgcccctggaggcgagagctatggcggcaccggcgtcacggtaatcccggagaacaagtccagcgaggccgctgccgccctggcagtgctgggctacagccagagcgagattgccgtagctctcaagggcattgacgtggacggccttgccctggaggagatcatcaagcaggcgctgaaaaggatggtcaagaattaacgtcgggctaaaaatgcgcttggggagcggttcatttttattgcacgcatctacgtcagaatgaggaagtgaacatacttgagcattgacttttccgataccgggtttgagacccaggagccgctcgtcaccacatcgctgacgcgggatgacgagaacgagggttccctgcgccccaagaccctgcgggagtatatcgggcaggagaaggccaagggcaacctggaggtctttatccaggccgccaaaatgcggggcgagcccctggaccacgttctgcttcacggcccgcccggcctgggcaaaaccaccctcagcggcatcattgccaacgagatgggggtcaatatccgcatcacctccggccccgccattgagaagcccggcgatctggccgcgctgctcaccaatctggcggagaacgacatcctctttgtagacgagattcaccggctcaaccgctcggtggaggagattttatacccggccatggaggacttcgccatcgacatcatcatcggcaaggggccctcggccaactccatccggctggatctgccccgcttcaccctgatcggcgctaccacccgggcagggcagctctccgcacccctgcgggaccgcttcggcgtaaccctgcgcctggagctctacacaccggaggagctggcgcagattgtcacccggtcggccggcctgctggacgttcccatagagtcggacggcgcaatggagatcgcctgccgcagccgcggcacgccccgcatcgccaaccgaatgctgcgccgggtgcgggactttgcccaggtgaaggccgggggtgtgattacccgtccggtggcagaccaggcgctcacggcactggaggtggaccacctggggctggacgccgtcgaccggcggatgctcgccagcatcattgagcactacggcggcggcccggtgggcctggagaccctggcggctaccatcaatgaggaggcaattaccctcgaggacgtctatgagccctatctgatgcagatgggttttctcacccgcaccccccgcgggcgctgtgtcacccgtcgggcctacgagcacttgggcctgaccgtgcccggcggggcctgcggactggagcagctctcgctgtaggggggagctgggtgaaaaagaaccccctggttcccatcctgggcggcggtgtaatcgcggcgctcgttctgggcgttatggcggtaattgtgctggtggacgccgggctgctgcatctgctgggcgtccgctgcgactccttcggctggctggtgctctatgttctggtggaggcggtgctcggcctgcccctggagctgttcaccgctggcctgaccaaggcgctggtcaagctcggctgggccagtccccgtctggccaatctcctctacatcccgctggacgccctgtgcaccgtctttgccttttgggtggccgatatgcttatggagccggtggaggctaacctcctcgccgttttggtggtggggctgttgtccgccctgttctccaggccggtgaaacaggcggtgcggcggaagaaaacgccgctggagggggagcatgaccaagcgaatgacgatcgactgaactgataagaatgaggtggctatcgaatatgggtaaattatttggaaccgacggcatccgcggtgtcgtcaacgacggactggacgccatgctggccttccgggtgggcatggccgccgcgcaggtgatgacccgggagaagggaggcggacagcctcgattcaccatcggaaaggatacccgcatctcctcggatctgctggagggggcgctgattgcggggctgtgctccgcgggggcggatgtgctccacctgggcgtgatccccacgcccgccgtggcgtggatcaccgtggacaccaaggcggatgcgggcatcgtgatttccgcctcccacaacccctttgagcacaacggaatcaaaattttcaacggccagggcttcaagctctccgacgagctggaggggaagattgaggaaattttgctgaacgatatcgccgtgcccctcaagaccggcggggagatcggtcgggtgatttacgccgatgagaaggagtcccaggattatatcgaccacttggtgtccaccattggctccgagctggcggggctgcatattctggtggactgtgccaacggcgcggcctctgccactgcggcccggctgtttgaccggttccccgacctgcacaccgacgtgattcacgccgatcccgacggcgtcaacatcaataacggctgcggctccacccacctggatcagttgaaagccatggtgaaggcgggcgggtatgatctgggcatcgcctttgacggcgacgcggaccgctgcctgatggtggacgaggcaggagaggagatcgacggcgaccaggtgatcgcagcctgtgggctggcgctgaaagaggcgggggaactggccggcggagctattgtgggcaccgttatgagcaatctgggcttgcaccgtttctgcaaggagcacggcattgggctgttctgcaccagcgtgggcgaccgcaacgtgctggagaagatggaggagtgcggctatgtcattgggggcgagcagtcggggcacacgattttccggcgctacgccaccaccggagacggccagctcaccgcgctgcaattcctggatctgctctgccgctccggcaagaaagcctccgagctggtaggggagtgcaaacgctatccccaggtgctcatcaatgtgccggtggccgataaggcaaagaaggaggccgtcctgtcggcccctgcgcttcaaagcgccgtggcggagcaggaggaaaagctggccggaaatggtcgtgttctggtgcgcccctccgggaccgaggctctcattcgcgtgatggtggaggctcagaccgagcctgtagcgcgggagacggcggagcttttggcaaatgtaataaaaaatcatggatcttaacgggaaatttttgcgcaaaagcttgacaaatccagaattatccgcgtataatgtataaggagaaccggtatgaaaccagatcatattccttcccaggaactcacggacgaaacgctgtgccgtttggccgcctccggcgaccgtgtggcggaagagcgtctggtcatgcgctataaccgcttggtgcggatgtgcgcacgcccctattttctggcgggcggcgacagtgaggatctgattcaggagggtatggtcggcctgttagccgcgatccgagagtatgactcctccaaagcggctgtatttcgcacttatgcggaggtctgtatcaagaaccgcctgttctctgtgataaaagcagcagcgagagataagcacacaccgctgaacaactcagtctcgttcgaaacccctctttttagcgggaacggagatcggtttgcctaccatgcgccaggccggcaggtggaagacccggaggagatatttctcagccgggagtccttccgggagcggatggaaacactgatgggccaattgtccggtttcgaagcaagcgtacttcggttgtatctgaacggtctgtcctattctgaaatcgcagccgaggtaaacaagtccccgaaatcggtggacaacgctgtccagcgcattcggcgcaagttggcacagcaatcttcatctggcgatgtcagcgtaagctgaacgcaatattactgacccagcacaatcggatcatccggacctgggcaacaaagcaaagagagggtaaaatcatgtacgaagacaagactctggtatgtaaggaatgtggccaggagttcgtgttcaccgccggtgagcaggagttctacgccgagcgcggcttccagaacgagccccagcgctgcaaggcctgccgtgatgcccgcaaggccgcttcccgtggcccccgcgagtatttcaccgctacctgcgctgcctgcggcggcgaggccaaggtgcccttcgagcccaagtccgaccgtcccgtgtactgcagcgactgcttcgcccgtatgcgcgagcagggctaacagccaacttgaaaaggacgcccacaggggcgtcctttttttgtccgctgatgttagggaaaagaaaactgtgtcttgaaaaaatcagaaaaataggatatactactaatatcctagaattttggaggtattacacctatggctcagattacaaaagatacgattatcggcgacatcctggatattgcgcctgagaccgcgcccatcttcctgtccatcggcatgcattgcctgggctgcccctcctcccgcggtgagactgtggagcaggcctgcatggtgcacggcgtcgaggtggaggagctgctggccaagatcaatgccagtgtggccgccgcgcagtaaaagactccggaaccaaaaaggggcggccctccggctgctccttttttatcatgaggtgataccgatgagaaccgttgaacttaccccccgtctgcggtcggtggccgagctggtgccccggggggcgcggtttgccgatgtaggaaccgaccacgcgtatctgccggtctggctgctgcagcaggggaggattaccggggcagtggcctcggatctgcggccggggccgctggagcgggccaggggcacggcggagaaatacggcctgaccggccggatggacttccgcttgtgcgacgggctgtccgggatacagccggatgaggttaataccattgccatcgcggggatgggcggcgagaccatcgcggccattctggccgcggccccgtggacctgggagcgggaatgcctgcttctgctccagcccatgagcgcccagcccttcctgcgccgctggcttcaggcccacggctataccatccgacgggagctgctgagccgggagggggacaccctttacacaacctttgaggtgtacgctggccccatggcgaagctgaccccggcggagctgtgggcggggcgacagaccaggggagagggttcccccctgcggttggcttacctagaccggctgctgcggcaaacggagcgcgcgatagcagggctgaagcggtccaaacgtccggaggatgcctcccgcctggcagagctggaacaggtacatcagggactattggacatgaaggaggagtggctgtcatggcaacggtgagagagatttatcaatatctggacggactggccccgttttctctgcaaatggagtttgacaacgccggttttctggtaggccggggagaacgggccgtgtcaaagattctggtctccctggatatcacggaggaggtggcggaggaagccgccgagctgggggcggagctgatcgtatcccaccatccggtgatcttccgcccggccaaatccgtgacggacggcgatccggacggacgggttctgctggcgctggcggagcacaggatcgccgccatctgcgcccataccaacctggacgcggtggcggggggcgtcaatgacgccctggcccaaaagctgggactggtgcagattgagcagctccatcaggacggggtggatggctccgggcgtccctacggcatcggccgggtgggcagtaccaccggcacccccatgtatgcccccgcctttgctgcctttgtcaaggaggcgctgggggccaacggcgtgcgctacgtggacgcccgccgcccggtgcgccgggtggccgtggggggcggcgcttgcgccgacctgctgcgggatgccctggccctggggtgcgacacctttgtcaccgccgacgtgaagtataatggcttcctggacgccaaagcccttggggtcaatctgattgacgcggggcactatccgaccgagcaggtggtgtgccccgttttggccaaatggctggccgccggcttcccacaggtggagattctttccacgagccgccataaggaggcctttttatacctgtaagggcttgcaaagacgcgcaaatagtgataaactagttccgctgattttcgattgcaggaagggaacgaatcaatatgtcaggacattccaagtggcacaatattcaaaagaccaagggcgcggcggacgccaagcgttctcagatatttaccaagatcgcccgtgagatgatcgtggcggtcaagaccggcggcagcggcgaccccaacaacaactcccgcctggccaccgtcattgccaaggccaaggccgccaacatgcccaacgacaatatcaagcgtaccattgacaaggcgcttggctccggcaatgccgacagctacgagaacgtggtgtacgagggctatggaccctccggcgtggccgtaatcgtggacgcgctgaccgacaaccgcaaccgcaccgctcccgaggtgcgccacctgctggacaagtacggcaagggcctgggggctacgggctgcgtgtcctggtcctttgaccgcaagggcgtcatcatcatcgagaaagaggatctggacgaggacaccgtgatgatggacgcgctggatgcaggcgcggacgatatgcaggtggaggaggagacctttgaggtctacaccgaccccgatgctttcggctccgtgctggccgccctggaggagaagggctataccttcgtccaggccgccgtggagatggtgcctcagaactatgtcaagctggaaaatgaggacgacatcaagaacatggagaagctcattgatctgctggaggacaacgacgacgtacagaacgtctggcacaattgggatcaggagtaacttcagacattcaaaacggaggtctggctttgtccagacctcctgtttattcataactttaccaaggaaaatccgacctgccatctgacgcaatgcaacttcaagaggttccagaagcgtttcaggtgttgcctgtccgaaaaaaacggccgcccggagcgctgtgctccgggcggccgtatctgcaagtaagcctgtaagccgggttctgtcctttaagacagccatctatctcgacgcaccgttgccagtacgctccagccgcctccccgggacggtcgggccgaccatatgtccctccacggcgttgctccggatagagtttacagcgacggacgcttggcacgccgtcgggtgagctcttacctcacctttccaccttgaccggccagaggccggcagactatttctgttgcacttttcctagggtcgcccccggcgggtgttacccgttatccttgccctgcggagcccggactttcctcacagacaggcctttcgccccgtccgcgcggctgtccagcttgcttgcgaaggacattgtaccgtattgtgggccgcttgtcaaatgggaatcgcactcctccagcgaaaacagggccttttcatagtcctggacataataccgcaggtgcttccgccctctggagagcacggtatgtccctcagcttccagaagcgccttctgagcctccgcgccccccggatacttttcattcagctctccgccggttttcagcgtccgccagtaagggatcttgtcttcggcgcgctgatggctggcccaggcggcgatggacacaaaaagcccggccgtcaggggttcggtaaagtcggcgccgctccgccgggcgagatagctccggatgtcgccaacagtcaggagcttcccgaagggcactctccgcatcgcgcggtcgtaatcgatgggcggggcaaagtacatgcggtcgcctccataggctgcaatcgcctttggatcggtaattatctgtatcttcggcatgtccctgcgggcgttcagcatggcgttgaagtcttttcgtgcctcatttgacaagaaaatccctccagtccgacttttttcccacattttatcaaaatggccggggcaagtcaatctcgcccgaggaaacgccctcctttcgattgaaattttctcctcaataggatataatattttagttatagacgaaacaaaaagggaggaacgagccatgggttccaccatacaggagtatttggcgtccctgcggggcaagcgggtggcggtgctgggcatcggcgtgtccaacacaccgctcatcaaaatgctgctgcgggcggatgttgaggtgaccgcctgcgacaagaggcagagggaggacttcggcggccaggcggaggagttggagagcctgggggccgagctgcgcctgggcccggactatctggacgggctggaccacgatgtgatcttccgtacccccggcctgcgtccggacgtgccccaactgctggcggcccgggaacgggggagtaccatcacctcggagatggaggtttttttccaggtctgcccctgcaaaaccatcgcggtgactggcagcgacggaaagaccaccaccactacgatcattgccgagctgctgaaagcggcggggcagagcgtctatgtgggaggcaacatcggcaaaccgttgctgcccgacgtggacgggatggtgcccgaggacgtggccgtgctggagctgtcttcgtttcagttgatgaccatggagcagagcccggatatcgcggtggtcaccaatctggcccctaaccacctggacgtacacaaatctatggaggagtacatcgccgccaaggagaacatcttcacccaccagggagcggacggcctgctggtgctgaaccaggataacgagatcacccgcggctttgcggccagtgcccgcggccgtgtgacccggttcagccgtcgggaggagctggagcagggcgtcttcgtcagagacggggccatctgggtgcgcaacgccatgcacgagcgcccggtgctctacctggaaaacatcctcctgcccggcgagcacaacatcgagaattacatggcggccatcggcgccctggacgggctggtgcccgaccaggtggcgcgggacttcgccgccaaatttgcgggggtagagcaccgcattgagctggtgcggacgaggaacggggtgcgctactacaacgactccatcgcctccagcccctcccgcaccatcgccggtctgcgctccttccatcagaaggtagttctgattgccggcggctacgacaagcacattccctttgatgtgctcggccccgaggtggtggagcatgtcaaggcattggtgctcaccggcgacaccgcgcccaagctgcgccaggcggtggagcgggcacccggttacgatccggcggccttgcccattgtggaatacaaggattttgaggcggcggtgctggccgcctgcgggctggcccagccgggggacgtggtgctcctgtcgcccgcttgcgcctccttcgaccgcttcaagaattttatggagcggggcgcagcttttaagaggattatctacggcctggagtaaggctgcggacgccggaggacacggcctccggcgccctgcttcggtatccgtggaaaggagtgaacccaatttggatatgagacaagccctggagcggctgtgcacctgcaccgcgccctccggctttgaagcccctgcggcagcggtagcggcggagctgctccggccgctggtggacgaggtgtccgtggaccgcatgggcaatgtgctgggggtgcgccgatgcgggaaggagggggcgccccggctcctgctggacgcccatctggatgagatcggcctgctggtcaccggcgtggaggacggcttcctgcgcttccgcagcatcggcggcgtggatccccggatgctgcccggccgggagatggtggtgctgaccgacccgccccggcggggtatcgtgacctgtccggctgggggggaagcagacaagagcatccccctgtccgagctgttcgtggacgtgggcctgtcccagacggaggcggagcgggccgtaccggtggggacgcccatggtctatcggggcggctgcgttgccttgggagaggaccagatgtgcggcaagtccatggacgaccgctcctgcttcgtcaccctgctgcgggcggcggagctgctgcgggacagggggctggacgtagacctctatctcctgggctccacacgggaggaggtttccggggcgggcgccacggtaggcacctgggcggttcagcccgacttctgcgtggcggtggacgtgacccacggcaaaacccctgacggcccggcggacaaggccttcgccattggcggcggtcccgccatcggcgtgggccccaacatgacccgctggatgaccgaccggatgctcgccaaggcgaaggagaggcagattccctaccaactggaggtcatgtccggccataccggcaccaacggctgggagatgcagatcagccgggagggggtagccacctcggtgctgtccctgccgctgaagtatatgcattcccccattgaggtgctctccctggcggacatggaacaggtggcggccctgctggccgccttcacggagggactgggaaaggaggcggcacggcgatgagagaactgctggagcgcctgtgtgcgcttaacgccgtgtccagctgggaggacgaggtgcgcgccttcctcctggcggaggtggagccccacgcggacaggctgcgggtggatgccctgggcaacctgattgcctggaaaaagggccggaaacataccggcagcaagcttctcctcaccgcccacatggacgaggtggggctcatgatccgccagatcaccgacgacggctatctgaaattcgacactgtgggcgccatcgaccgccgggtgctcctgggcaagccggtgctggtagggcccaagcgggtgccgggggtggtgggactcaaggcctaccatctggtcagccgggaggaggagaagtccgtccccaagctggacgagttctatatcgacatcggagccagggaccgggccggggcggaggcgcaggtcgctctgggcgatacggcggcctttgacagtgacgccggagacttcggggcgggcctgttccatggaaaggccctggggagccggttgggctgcgccgtgctgctcaccctcctgcgggatgaactgcccatggactgtacctttgtctttaccgcccagaaggaggtgggggcccgcggggccttcggcgcggccttctccgtcaccccggaggtggcgctggtggtggacggcgcggatgctgcggatctggccggagtccctgcccacaagcagggatgcagcctgggcggcggtgtggtgctgccctatatggaccagggcgccattgcggaccggggactctttgaggcgctgcgctccctggcggaatccggcggcataccctggcagaccatgcgctcggtggacgggcgcaccgatgccgccgccatccagcggaccaaagagggggtacggacggcggcggtgtccatccccgtgcgctacccccgcaccccgtccggcgtgacctgcctgcgggacgcggaggcggccctggccctgatccgggcctttgttggacatttggcagaaaaggagtgaaccgacatggaactgattgagattttgcaggccctgaacgcctgtcacggcccctccgggagcgagggggccgtcgccggggtgctccgcaccctggccgctccctacgtggattcctgtaccacagacgccctgggcaacctgatctgccataaaaaggggagtgggcccaaggtcctgtttgccgcccatatggactccatcggcctgatggtcacccatatcgacgagaagggcttcctccgcttcggtccggtgggcggtctctccgcccacgaggtgctgggcacccccgtccgcttcgccaacggtacccgcggcgtggtggccctggagggcaaggtggagcccaaggacatgaagctggagcacctgtacctggacattggggcccgaaacgaggcggaggcaaaggccatggtacaggtgggggacattgcggtctatgacacccacgccttctgctccggagggcgcatcttctctccctatctggacgaccggatcgcctgcgcggtgctgctgatggcgatggagcgcctgaagaacacggaaaatgacctgtacttcgtctttacggtacaggaggaggtgggactccgcggagcccgcaccgccgcttacggggtggcgccggactacggcattgccgtggacgtgacggactcagacgacatcccttcggccccccatgcgtgcagcagtgtggccggaaagggggccgccatcaaggtgatggacagttcggtgatctgccacccttctgtggtggccaagctggagaaacttgcactgacaggtaacatcccttgtcagaaggatatcctgcgctttggaggcaccgacgccggggccatccaccagagccgggccggggtgtataccggcggcatctccattcccacccgctatgtccacacgccgctggaggtggcggatctgggagacgtggaggcctgcgcagccctggtggcagcctttgcccaggcgaagctgacctgctgagtcctcaaatacagaaagaacggaatgtgtaaaaagaaatgcctttacagattagtgaaaaagtaatggccctggcggcccaggcgcaggccgggctgcgggaccaattcgaccgcattgattccatcgcggaggagaacacccgcaaggtcctggccgcttttcagaagcaccgggtggcggaggcctattttgccgggaccaccggctacggctatgacgatctcggccgggacaagctggatgagatcttcgcggagctgttcggcaccgaggatgccctagtacgggtgcagtttgtcaatggcacccatgccatctcctgcgccctctttggcgcgttgaagcccggcgacattctggtgtccgccgtgggtgccccctacgacaccatgctgggggtgatcggcgtggtggacaagggccccggttccctgaaaagttacggaatcgaatatcggcaagtagatttgcttgacgatgcgccggacccggaggggctggcccgggcggtgcgggacccccgcgtcaaggcggtgctgatccaacgctccaagggctactccacccgttcgtccctctccgtggcggagatcggggcgctgtgccaggtggtgcgggccaacaacccggaggccgccattctggtggacaactgctacggcgaatttgtggagacattggagcccacccaggccggggccgacctggtggtgggttccctgatcaaaaaccccggcggcggactggctcccaccggcggctatattgccggacggcgggatttggtggagggggccgccatgcggctgaccacccccggtatcggaaaggagtgcggctccacctttggggccaaccgcagcctctatcaaggacttttccttgccccccataccacggcccaggcagtcaagacggcggtgtttgccgcccggatgatggagctgctgggctaccggacggagcccacctccgatacggtacgccacgacatcattcagatgatccacttcggcgcgccggagcccctcaagaaattctgcaaaggcatccagttcggcgcgccggtggactccttcgtaacgccggagccctgggacatgccgggttatgactgcccggtgatcatggccgccggggcctttattcagggggcgtccatcgagctgtcctgcgacgcccccatgcgtgagccctatacggcctatctccagggcggcctgacctatgagagcggcaaggccggtgtccttctggcagtggaagagctgctgcggggcgaatagggcaagccggttcgcgcataggctgatccgggaggtgaggcccgtgcgcagaccgatacgcccctggctgagggtgcctcgccggcggcggcccgccgctgcgcggccaaaaggggggattctgctccccgtgctgatcgggatcggtctggcggtggcggtcattgttttgatcgacgccgcactccggcccacagttacagagctggcaaaggccaaggtaaaaaatgccgtaaccagcatcataaacgacgcagtcaatgagactctgtccagcgaagccatatcctacggcgatctggtgacgttggggaaggacaccgctgggcaggtgacagtgttggccgccaatacagcccagttgaacgcacttcgcacggagatcttgggccggatattggagcaggtggaacagcttgacagccaggagctggggatccctctgggaagcctgaccggctttgccaccgcgtcggatttggggccggtactgccggtacgggtgttgactgcggccacaccgaccgctgcatttgaacatgtatttacctcatccgggatcaaccagacccttcatcaggtcatgctgaatgttcaggtggagtgtaccctgctgatccccggcggcgcggtggacacggtcgtggaggcacaagtgtgtgcggctgagacgctgctggtggggcaggtgccagatacctatctggagctgcccggaggtttgtaagaaatccgtaaggaatttgtaacgaaaccggcattccctctatggtagaatcgggacgataccagtaggagggaaccgaaatggatacactgctgtggtactgggcgatctcctgggactatgtggcccagatgctgccctgcatgctgttggccgcccttgtatttttccttatgcggccttggcgaaaaaaacggttagcccggcaaggtatggccagtgggggactccgcgaggccgcgctgctgttctttgtgatgttttgcgccggactggccgcgctgaccgtctttcccgcttatttctggacggcgtaccactggcaggaagcgctggccgggcatgaggtattttttccgctgactccgctctctgagtcgatacaggagattcagtggacccctacggtccttcaaaatctgcgggaaggcggctggggcggatacatggccatcgccaatctgcttatcttttgcccggtcggctttttttcggctttgctgtggagggggaatcgctgtatgcggggccttctcaccggcttttgtacgtccttttgtgtggagttcctacaactgtttgtggggcgggccactgacatcgatgatttgattcttaatactttggggggatgcttgggcgggcttttgtgcctgattttcgcccatttggccccccgattcacccgacgattccaagtggaggtccgatatggacgagaaacaggagatacagagcctgcgccgggagctggagcaggcgaactatgaatactatgtgctggacaaccccagtatgtccgactacgattttgaccacaagctccgccgcctggaggagctggaggcggcccacccggagctggttacccccgattctcccactcagcgggtggggggcaaggtggccgacggcttccaggaggtgcgccaccggataccgctggagagccttcaggacgtgttctccgtggaggagctggaggagttcgatcagcggatgcaggaggccctgccggagggcgttgaatacgatgtggagcccaaggtggacggcctgtctgtggcgctggagtatgaaaacggcctctttgtgcgcggcgccacccgcggcgatggccaggtgggagaggatgtgacagagaatctgaggaccatcccttccatccctctgcgcctgccggaggccctgcccgccctgattgtgcggggcgaggtgtttatgcccaaaaagagctttgaacggctcaacgaggagcgggaactgagaggggagagcctgttcgccaatcctcggaatgccgcggccggctccctgcggcagctagaccctaaaatcgcggcctcccggggactggatatccgggtttttaacatccagtgggcagagggaaaaacctttcagacccattcagaaaccctggaatacctgcggaaacagcactttaaagtaattccacatgacacctgtaaaacgattgccgaggcggcagagcgtatccaggccatgggggagggcagagaggcttacccctttgacattgatggtgcggttgtaaaggtgaatagccttgcagaacgtgaaaccctgggcagtacggcgaaatttccccgctgggcggcggcctacaaatatccgccggaacagaagccgtcccgggtggtggacattgtggttcaagtggggcgtaccggcgtgctgacgccgaaggccgtagtggagccggtgcgtctggccggcaccaccgtcacaagcgccacccttcacaatcaggatttcatcgcggaaaaggacatccgcatcggagatactgtgctggtacagaaggcgggagagatcattccggagattgtggaggtgctgaaggagaagcgcctggagggggcgcagccctaccacctgccggagcagtgcccggtgtgcggcgcgccggtggcccgcgacgaggatggggcccacatccgctgcaccggcgcagagtgccctgcccagctcctgcgccatttggtccacttcgccagtcgggacgccatggacatcgagggcctgggccccgcggtggtggagaatctggtgggtgccggtctggtcaaggggcccggcgacctgtaccacctcaatgcggaggaggtggcccagttagagcgcatgggcaaaaagagcgcggaaaacctcgtcgcagccattgaacggtccaagggcaatgacctgtcccggctgctgtttgccttcggcatccgccaggtggggcagaaggcggggaaggtgctggccgcccgctttggcacactggatgcgctgatagcggcctcggaagaggaactgactgcggtacccgacatcggcggaatcacggcccgaagcctgctccagtggttccagagcccccagagcattcacctcattgacacgctgcgggaagcaggggtgaatctggaaagccatgaggagccggtgggcgaccaactggcggggaagatctttgtgttgacaggtacgctggagcgatttacccgggacgaggccggagcgatgatcgaggctcagggcggcaaagtgtccggctctgtttccaagaagacctcctatgtggtggccggagaggcggcgggctccaagctgcgcaaggcccaggagctgggcatcccggtgctcaccgaggaggaattccttaccatgcttggcagcaggctcgattcggatcaattataaaaaggggcaccggttctcaaggagagccggtgccctttttgtgttctgctgcataggatgcgtggaaaggggagagcgctatgctggaacggataccctatgaccgccgtgccgctgtggcctatgcccatcagtgggcctacggacgaaatccggatttctatgactatgaggagatcggcggcgactgtaccaattttgcctcccagtgcctgtacgccggaacgggcgtgatgaacttcgacccagtctacggctggttttaccgggatcccaacgacaaggccccggcctggaccggtgtggagtatttttttgactttatcacccgtcagacgccgagcccgggaccctttgggatttctaccacgctgagtgagctggagccgggagactttgtccagttccgcttcaataaggatgtatttggacatactccggtggtggtggagatcgggcgtccagccactttgcaaaacaccctgattgccgcccactcctatgatgccgactggcggccgctgagcacttattattttcaggagatccgcttcctgcacatacagggggcctaccgggagattcgcggagaagaggttcttccaagcatgtaaaagccgctcccctgtccaattgtggacaggggagtttttcgggcttgtttgaaaaagtacaggtttctgaacacctgaattccggggaatttcatcctctattctatcatatcccctggaaaacgcaataaaaaaggctatttaaaaacctgtactatttcaaagtgctatgaaaaatcgtaagcaggcagaaaggacagtgattggaatgggacaaaacctgcgcttgaactgtaccgcacacctcatgcagaggctgttgctgacggccttttttatactggcagtctcggcgctggcagttggcatatctcagggggaacggtatctccaggcatttgccctggcgctgctggggctttttctgtatactgccctgtgtgtacctgccgcgaaacgattggaacatttggggccgttgcggctttggctgcttctcaccatactttgcgtcgcaatcaaagtattttggatctggagggtacgggttcccctggcgggggattactcggtcttttggggatatgccaatgcgcttgcggagcgcacaacggtatacggcgggcggtatatggccctgtttccccatattttcggatatgccgattttctgagctggtttattcgcctgtcggggccacagcccatgcttgctccggtgctcaatgtactgctgacggtctgctccggcagttttttgtatcatctgtgcctgcgctggttccactcgccggccgctacgctggtctatctgctctggactctgtgtccatctcagaccatctataacagccttgtgctatcggagcctctctatactgcccttattctcggtgtgctgtcccttttgacggagacggagcggtttgccgccctaaaggggtatccgctttggataggggttctctccggcacggcgggcggcgttcttctgcgatgggtcaacggggtgcgccccattgcggccatactgctgatcgcgctccttctgtggatctctctgctgaacctgaatcggctggccgcccggaactggagaagatggtgggggctctgcatggccggtgtgctgggggcctatgtccttctggggccggtctggaatgcccggctctcggtacggataggggaggagccgtcccacacgccggggtacagcctattggtcggcctcaatcccgactccggagggcgctggaatcaggaggacagcgaccgcctgtatggatacagcgaccagcctggggcaacagctcaatggacacaggaacagcttttggccgatgcagaggcccggattttatctggagaaattgacttttcaaagctcctaaagcaaaaactgcgcacgtttctgggatcggacgatgcctgcgtgggatattcggcctcggttctgcggcatacggcgtttttctccctgctctgtaatggcttctattatgcggcatttctcctggcaaccggtggtgctgtccaggtgtggcggagcagagagagaggattgctattgctggcaccactctatatcttagggctgaccctggcacagatgctggtcgaggtggcggggcgctaccactactcgatgatacccatgcttttactgcttggacaggggacatggaagaggacaggtgaggaatagaaataggaggccgctctcaaagagagcggcctcctatttctattttccagggggaatggggatggatttctttttcattcgtcccagcgggtttgccttcgccgccgagcgcagattttcgttgtccacatgagtatagatctgggttgtgttcaggttttcgtgtcccaacacctcctgaagcgtgcgcacatccaccccgttctgcagcataagagtggccgcggtgtgccgcagcttatggctggaatagagagaggcatccaacccggcttttttgaggcgctgtttgaccatatagtgcaccgcatccttggtcatacgggtatgggtgcgggtcaggaacagggcgttcgggtcggccgcagcctgacggctgcgctcctccagccagtcatccagcgccgcgcggcaggcctcgttgaggaagatcatgcgctccttgttgcccttgcccagaacacggagctgttcctctcgaacatctgtcgtgttaagggagactaactctgaaattcgcaacccgcagttgagaaacagcgtcaaaatgcagtagtcccgcgcctgattgggctcgtccacggcctccagaagctggatgctctcatccaggctgaggtagcggggcagcgattttttcagccggggggaatccaggtcctgcatgggattttcgctgattaattttgccttgctggtgagatacttatagaacgagcggatggcggcgatttttcgggcccgggcggtggcctccaaaccatagccggtggaggggctgttggcgtgcttggcccggtcacggctcaggtaattcatgtaggagtagacatcgctcagcgtgacagacctggccaggtccagatccacgtcgtcaatcggaatttcatccagctcggcggtacgtggtgctttgcctttttcgattttcacatagcggaagaagttgcgcagatccaggtagtattcatccaccgtttttctggagtgaccctgaatggtctcatgatacaccagaaagtcccgcagaaccggcggagcagtcagacggtagtcatttgtattcaaatcctccctccaactcaacaaaatttttattttgttgagttggagatatacccccctctcgaagaactccccccagtttaccacgcctgtgttggctggtcaagcgggccgtttgcggcgcttggcctgcttgagcttggcgtcgagaagcttgtcggccatggcgtagataagggtggtttcgatcgagctgtggttcagggcccgctggacgcgctggatgtcgccgtagcgctccaggagttcgacggcgtagaccttgcggaggctgtggggcgcgacgttctgcgggagccggaacgccctggcggcgcgcttcacgtcggcccagacggcctgccgggtcttgtgggtgcccgggcgcttgcccgggaacgcccattcgggcccggcctgggcccggatggcggccaggagcgaggccgtgaggcccaccctccggcgcttcttcgtcttggcttctgtgaccatcatttggagcccaatatcttgtgtccgaagggatacgacatcccccacccgcagtccggtgtgtaaacagacccgggcaatgagcctgttttgaggcataagcgcggccaggacgtgccccacctcgcggtgaagcaggtaatcggttttcaagtgtaaatcaaccccttatctttcagcgggggtaaaggccctccgcctgcccccggaggcccgccggagcgggccccctggggcccattgaactttcctgaatctgtaaaatgcgcccgaaatccaaccaaacggttgcatatttccagaaattagttccgctgtttgagggcgctagttttttccatcgtctccagatgcaggctcccctccggcggccccctggagggcggcgaagaagcttgccacggcctccgggtcgccgtcctgcgggaggcccgccttgaggatggccccgagggccgcgcccttgtccatgagctccacccggaccccgccgccgggcttgacctccagctccaccagggcgcggagatcggcccccttcaagttggggggcttcccctccgccacggctagggccagtttgaccgcatcgttgggcctggcctctagcaagctgtatgccaactcttcccacttcatcctgtaaaactcctttcctttacagccagtagtccaaggcctcctgctcccactgttcttccatggcatcgaacagacgttcgagtgccgcctcacgggccgccgccctgcgctccgcgcaggcctggacgcaggcccagcaacggcggctgtcgcacagctcccaccaggggcacctcagattgacctccagcaactttttcgactggttctccactgttttcaccccctttcgcctggaattggaactggacgaagctgatacccgcctggggcagatcgaagcggtaggcccccggttcctgctcggcctggcggaagtccagctcggcgtaggtgacctggggccgccccagggccccgccggagtagtaccagcggcccccaatcttctgtggctccaagccgtcaccatttggtgacggggccaactccttgccgatgtacttgcagacgtagctgacggcccggtcgtactcgccgtacagctctatggccgtcgtgaagccccaagaccagccgggaaggttgtagacgggttcccccccgtcctccagccatttggcccgctggcgggcgctcctgggcctcctgggggctttctggccgggcagagagatagttccgctgtccctggcctccagcgcgtcgttgaagaagccgtggaagtggatagccccgtccttgtgccgctccggcaccaggacgtaagccaggcccttccgcctgacctggttgtccagccagtggttgaggtgccgtgtgacctcccggacatcgtagcggttcacccgggccgggtcgagggtgagggtgacgaaccaccggaagggggtgcacagggcgatgtcccgcacctgggcccgggcgcggcggacggcgcgggccacgtcgtggccgccgtccttggccctggactccttgacccgggcaccctggcgggcctcccagccggagccgccaaagatggccttatcgcagaccagggcctcacagcgaccccccggataggatttgacgcgggccgtacagaagatatcggagccggaaacccctgtgcccgtaagctttgccatggttcagcccctccccccctgacggaataatgtcctaatatcaagtagggcctgcggccccctcccggttgacgggagtccggcagttacccgggctggcatggagccgccccggggccccgggcccgtcgggccgcgtgtcgggggcggccctctgggcccccccggtgcggtcgccccgtcctgcgggccggggcttctgcggtgtgctcggccccgtcggcccctccggggggcgcttcgggccgctccgccgccctgcgccctcccccgtcgggcttcgcccgccccgccgtgctccctcggcctcgcccggcggtcgtggcggcgggtgctgtcctgctcggcctcggcggcgggccgccgttcgctccctaggggtcgctccctggctcgggctgtcgccgcctggcctcgcccgtcgcccggctccgcgcgcccccccgcgtcccggcccctggcccgtcctgcgggccgggccgcgccgggcccggtcgctggcgcttggggtcggccttggcctgctccgtggcccctggcgggccccctgcgcggctctgcggcctccccctctgcgcgccccctccctcgcggggccccctgcgctccgccccctgcggggccctgccgggcccctccgggggtcggcctccggcctcccgggctcctcccgccgggcggggctggcggccctgcgggccgcctgttccgccccgccccgcccggcggcgggggtgggcctcaccagggccgccgcgtcagcgcctcccggaacggcaccccctcccgcttgcacaagtcgatcagctcagtgtttatcaggctctcgcatcggtacttgtattccagcctgtcccgctctgccctggccgcctccgcctgggcctccagctccgccaccctggcccgcagggccagcacctcgtcgtccgggctcagccggacgtggatttcgatgggctccatgcgctcccctcctgtctgtcaaatcccactttacactccggggccgcagggccgctttgtggcccgcccccgtctcccctgctcggaaagtcaattcctatttgacaagtgtagtgccttattcgtcacttttcaagcgtgacctattcgtcacgtgatataatcgtcacatcctacaaaaaggagggcttccagctatggaacttcacgacagattgaaggccgccagggaagacgcagacctcacccaagcccaggtcgccgagcagacgggcattgcccggcggcagtacatccgctacgaacagggagcccaggaaatgggcatagccaaactccgggccctgtgtctggccctgggtgtcagtgcggactatcttctgggcctgccccgggggctgagttggccccgctgacgcgggggatgttgttcaggggcggcccccttctgagggggcgcgcggggtggttgttcatgccctgcgggcatacaaaaaaggggcggaatactccgccccttttttgggtacaatatctaaactgaaaggtttttattttgttgagttggagatataccccctctcgattggagtgataccggtgagcctgatagcctgcaccagtgcgtgtgtctatcaacaggacggatactgcagattggagcgcgcatcctcctgcggcgtgccctgtgcggaatctccttgcgtcaattttgtgccacggcggaactgcggtacaaccgcgccgcctacaaaagcgcggccagcgcctcgcggatgttgcgaaccggaatgagctgcaggccatccggggtgtccagctttccgccggtacgggctgggatcaggcactttgtgaaccccagacggcgcacctcgctcagccgctggcccaacgcattgactgagcgcagctctccggtcaggccaacctcgccgatggcggccagatctccagacacgggcttgtctcggaagctggaagccagtgcgacgatcatggctaggtcggcggcgggctcgtccaaaaacaagccgccgatgacgttaatataggcgtcacaggaactgaccatcagtccaccccgcttttccagaacagccagcaacagattcgcccggttgaagtcgaagccgttggcggtcctgcgcggtacattgaagctggtgggcgccagcagggcctgtacctcggccaaaacaggccgcactccctccatgacgcaggtgacgcaggtgccaggggtgtcctgaggccgtcccgagagcagcatctctgatggattgggcacttcgctcaggccggagtcctccatctcaaagacgccgatctcattggtggcgccgaaacggttctttgccgcgcgcagaatgcggtaggagttctgctgctcaccttcgaaatagagcacgcagtccaccatgtgctccagcaccttggggcctgcgatagacccctccttattgacgtgtccgatgacaaagacggtgatcccctgccccttcgccaactgcatcagcgccatagtacagtcctttacctgtcccacgctgccgggagcggtggtcagatccccgttgtagagggtctggatggagtccacaattagcacgtctggcttcagctcgttgaccgactccagcacatcctccaggttggtctcagccagaaggtacattccctctccacggacatggagccgctccgcccgcagcttgatctgccgctccgactcctccccggagacatagagcacagaggcaaaacggcacaggttgtcgcagatctggagcatcagggtggacttgccgatgccgggggcaccccccaccagcaccagagagcccttcaccgctcccccgcccagcacccggtccagctcattcatcccggtttcaaagcggagctcgtgggtggtttccacctcgcgcatgggcctgggccggttgccggttccccgcaggccgcccccagcgacagaggcggcggccgcactcctttttttcggctctgccggccgctccacaagggtattccatgcccggcaggcgggacattggccggaccactttggggtttcatttccgcactcggtacaataaaacagtgtttttgctttcattctgaggcgacgcctcccttttgtagtgaaaagccttcccctctcccctcctcgtccagccattgcagccaggaggcggccaaggcggaggccagcttggtctgataggcgccggattgcagcagcagatcttcctctgcattggacaggaagccgcattccaccaggatcgccggacaggtgatgtggttcatcagatagacgctgtccgggatgggctttgcctcacgggtgttgcccgggtccagtgcggcccgcagtgtctcctgtgtgagttgtgccagaggttgactgagctctccgttggaatagaacacctgagcgccgtggtacttcccgtccggaaaggtattctggtgtacgctgagcaggacagcatgctccgtctcctcgatccgggccacacggttgtggaggtcggagacttttttctcccggagggtttgcgcgctgtcatcatggagggagatatcctcactgcgcagcagaagcggcgcctcgccgtacaatcccagaagctgatccagcttctgcacaatggccagattgattccgctctccggcacaccggagagcgagaccgcgcctccatcctccccgccgtgacctgcatccagaaccagggtctgcccgccgctgcggacgggagaaaaggccgccaaagcagcccggcccggccagaaccagaaaaaatagaccgtaccgacggccaacgcggccagcaggacccagcttccgattttctgcatatcaaacgccccctctcacacacggtatgagagggtattttttattataacacacctcataaatttttgttgccttttgcgtgcagacgcgataggataaaggcaggaaacaatggaggtgctttctatggtcgttgacaaaatcgagcatgcgtccctctactatggtctgggggaacggttccggacggcattggagtggctggcgtcggcggacgctggcgcattgacgcccggccagcgggtggacatcgacggggacaatgtgtttgcaacgctctttgaggtggacacgctgccgcctgaggcgtgcaagctggagtgccaccagaactatgcggacattcaatacctgctctccggcatggagggggcgggctacgccctgcccgacgcagagctccacgcactgagcgagtacgatccgaagggcgacatccagttttatacggccgagtgggacacgctcaccatccggccgggtaccttctacatcgtctggccccaggatctccacgccccccgtgtggcgctgggacagcctgggccggtgcggcgtctggtggcaaaggtaaaattaaaataagatacagcgcaaggcggaaaaaccggctgtcggccgccgcctgatttcaaaacccgctccatcgcccgcgttcgggccgatgtgggcgggttccctttttctctccctgcatagaatgtgacgaagggggctggtgggagccgcctccccccttccctcttcaatctatataaggaggaactgcgtttgtatcccgacaacaatatgccgaatacctgcggagacgcctgcggtaccatgcctgagtgcgccccgctggcggtcccgtatgtccccttccagcagaccaatcccaagcgctactcccagcaggatgcgctgaataacggtacgcttttccccggcctgaacctccccttccgcgtcaagccggacgcggcaaaggtgatgggcggcgcgctggcggagctccaggccctggagtttgttctggtggagctgggtctctacctggacacccaccagggcgacgcggaggcctttgagctctataagcagtatgccgcaatggaaaaagaggcccgggagaaatacgaggccatgaacgggccggtcactcaaatggccactgccaacgcgaagacatgggccgcctggctgagtgagccctggccctggaactatcaggaaggaggcatgaagtaaatgtttatttacgagaagaagctgcagtatccggtcaagatcgccaactgcaaccccaagctggcctccttcatcatcagtcagtacggcgggccggacggcgagttgggcgcctccctgcgttatttgagccagcgctattccatgccctaccccgagctcaagggcctgctgaccgatatcggcaccgaggagctggggcatctggagatgatcggcgccatcgtccatcaactgacccgcaatctgaacgatgagcaggtgcgggagggcggctttgcgccctatttcgtcgaccacaccaccggcgtctaccccaccgccgcctccggcttcccctggaacgccgcttccatggcggtcaagggcgatgtgatctgcgacctgtccgaggacatggccgccgagcagaaggcccgggttacctacgacaacatcctgcgcatgtccgacgatccggatgtcaacaacgtcatccgcttcctgcgtgagcgggagatcgttcacttccagcgcttcggcgaggcggtgcgtctggccaaggagaagatggaccagaaaaacatctactttaccaacccggcgtttgacaaataaacccatcagagcccccgcacagctttcgtgcgggggcttttcctgtcgccactgggcttgcgttttttgccgcttggcgctatgatctaatatagaagaaaaaaataaagagaagcggaagaatttcgtcaaattcactatagcgataatggagtgggcgcgtatggcaggggtccaattggaacatgtggtgcgggagtacaccatgggaaggacaaccattcgggcggtagacgacatcagctttaccataccggaggggaaatacaccatcattttgggggccagcggcgcgggcaaatctacggtactcaacatcttgggcggcatggactcccccacctccggccgggtgacggtcaacggcagggagatctccggcttcaacaagcgtcagcttacggagtaccgccgggagagcatcggctttgtctttcagttctacaacctgatgcccaatctgacggtgctggagaacgtggagctggccagccagatctgtaagaatcctctggactcccggcaggtgctggccatggtagggctgggagaccggctgaacaacttcccagcccagtgctccggcggagagcagcagcgcggcgccatcgcccgtgcgctggccaagaatcccgatgtcctgctctgcgacgaacccactggggcgctggactaccaaaccggaaaggctattctggccctgctgtacgatctgtgcaaaaagagccggaagaccgtggtggtggtcacccacaacggggcgctggcgccgacggcggacgtgctcattcggatgaaaagcggaaaaatcgaatcttttgaggagaatccgagtccggtgcctgtgcaggagctggagtggtaggatgatctggaaaaactttgtgcgggatctgcgccgcacggcctcccgcctgatctcggtcagcatcatcaccatgatcgcggtgatggtctataccgccctcagcggcatcctcaccaatatagagcgcatctccgcctcctatctggaggggcagaatgtggcggactactggctcacaggcgtcaatctggaccagggggactgccggacgctggagggcatcgcaggggtgaccggggtgcagccccgggtagttctggacgcggaggagcgccacgacagcggtgtgacgctccagctctatgccgtccccggggactacgccatcaacacgccctatgtggtggagggccgcctgccggagagcagccgggagatcgtgctcagcgatacgctggcaggggcccgggggctccatcccggggactggtacgagttgacactgacgggaaccggccggtacctgcgggtacggatcagcggactggtcaaagacccggagtgcctctactatgtgaataccacaacgccggccccggatttgacccactatgcctttgcctatggaaatgagacgcttttgcaggagctgatgggggcaaaccgctacaatcagatctgcatcaccaccgacggaagcctctctgcggcgcggctccggctggcggtggacgcggccctgggggaccgggtcgtgaacatcctgtcactggaggacaatacccaggcctactatctgctggagatgcgggacaatctggcgcccatactcaacattttcccggtgctctttttcctgtgcgcggtgctgatgatggtgagcaccatgaaccggctgatcgagaacgcccgctcggatatcggaaccttcaaggcgctggggtactctgacgccaaaatcatgtgctattatctgctccatgccctcctggtggtcgtggtagggttcccggtgggcgcatggctggggcggtatgtgtccgccctgatcgtttccaccatcgccatcgggtgtgatctgccgccctatacggtggtacacgactttgccgcctgggggcgggctctggggctgaccgccctgtgctgcatcgggagcgcctggctggtggcccgctcgctgctgaaggagaccccggcccagtgtatgcggcccaagccgcccaggagcacgaagcccgtggcgctggagcggctcggcccggtctggcatcggctgggctttaatcagaagtacatcatccgcaataccctccgcaacaaagtgcgtatggccacctgtatcttcggtatcgccttctgtatggcgctggtctttctggcctttgctctgcgggactccattcaggcctactcggacgcgctggccgagcggcagaaccgctacgacctcatggtggatctgagcacgtcggtgactgaggggcagtaccggcggctcgccaatgacgtgggtgtaacggaggcggagctggagatgagcaccgcctgctggctctacacggactcgcagcgggccacggcggcgctcacagtgacggaggatcaggtctcgctgaagcggtatgacccctatgccgagggcgcgctcacccttccggggaacgggctggtgctggaggagtccctggcgaatgagctgggactgcgggccggcgaccgggtgacgctccggtttgccggggacagccggtattactccgtgcctgtggcggaggtcaaccgctgtgtcagcggggtctgcctgagccgcagcctgtggcggggcctgggcctggcttacacgcccacggccgcctacctcaccagcgatgggccggaggcgctggccgagcggctgggggactatgacttcgtggacgcatggcagacccgtcaggccgccacagccgccgcggtggagcggctgagcagcatgtccatggtggtctatatcctgatcctgttcggcggcgggctggcctgcatcgtcatttacaatctcggtatcatgagcttctttgagcagctccgcagtctggcgaccttgatggtgctgggcttttatgagaaggagatcaagacccttcagttgagcgaaaacatcattttcgccgtgtgtgggattctcctgggcatcccgctgggggtttccctgaaccgcatgatcctggcctccatcaccaccatgcctctgatggaggctaccaggccggcctctctggccctgtcctgtgcggtgacgctcctgttcgcattggcagtcaacgtggtgatcgggcgtaaaatgcgggagatcgacatgctgggcgcgctcaagagcgtggaataacaaagaggtggatggaatgaaacgattgaaacagggtgcggctgcgctgaccggtgtgctgcttctgctgagcggctgctccggcggcgtggatgaataccaatgtgtgcatccggagaccgggactctggtgcagcagcttgtggagggcacagggacggtgagctatcgggaggagtattccgtcatccctaccgtcagcgccaagatcctctcctgttccatcgaggagggggacacggttacggccggacaggtgctctatgtgctggactccggcgctctggaggatcagatcacccaagcccgcctgtccctgaacagcgcgcaggcatcctatgcccaggcggtggacgcctgtacggatctgaccgttcccgcccatgcctcggggacggtgacggaggtctatgtccacgtgggagactatgtgaatacgggaaccgccatcgcatcactggtggacagcgctaacctcaccctgacggtgcccttcgcggcggaggacgcggcggccatggccccgggcaataccgcggcgatcacctttccgggacaggcgggcacggtcaccgggtcggtagaacgagtgtacgatacaccgacggcactctccggcggccgggagggcgtctatgtggagtttgccttccgcaatccgggcgcggtgctgagcgggacggcggctctggcctcggtgggcggcgcggcctgtatggaggccggaacagtggccaacgccacggagcagtccatctacgccacccagtccggccaggtggcctctctgcccatccaggcgggaaccgccgtcactgccggtcagacggtgatgaccttggagaacgccagcctgaccaacgccgtaaccaacgcctctctctcggtagaatcggcgcaggtcaacctggcccaactggaggccaagcgggcggactacaccgtgacggcgcccgtggacggcacggtgctggagcgcccgttcaagaccggcgactacgcggcggcggccacctccctggccaccctagcccagccggattccctgtgtgtctctgtggagattgatgagctgtatatcaatcaggtgggggttggccaactggcgcggatcacctttgcggacggccagacccatgaggcgcgggattacgacggggttgtaagccgtatggatgacaccggcgtgtcctccggcggggtgacggactacagcgtagagatcagcctgacccgtaccgaagagctgaaggccgggatgaacgtcacggtggagatcctggtggcccagagcgaggactgcatgagcgttccctctgaggcggtgacaggcggtgtggtccgcgtgctgcgggacggcgcgcgggagccggtggaggtgccggtggagaccggactgtccggggacggcgtgaccgagatccgctccggcctgtcgccggaggattgggtcgtcgtggatgcttattaagatggggtgtcgataggatgggaaacgaaatcaagacggtattgctgaaatcagtacaactgtacgatccagatcccaaagggatctgcgacctctttctgtgcggcgggcgggtcgctgccgtcggccgggggctagcccccaacctgcccggcgtggccgtgctggacggaagcggcctgacggcctttccgggcctggtggatcagcacgtccactttaccggcggcggcggagagtgcggcttccgcagccgtgtgccagagctgtccctcacggattttactaccgcgggtgtcaccacggcggtgggactgctgggcactgacagcgccacccgcagcccaaaggccctgctggccaagaccaaggcgctgaatgaggaggggctcacggcctattgcctgacaggggcgtatgacatcccctcccctactgtcaccggctccctgaaggatgatgtgacctacctctcagaggttctgggcgtcaaggtggcactgtcggaccaccggggcggccaccccacgcttgagcagttcatccatatggcctgtcaggtgcggctaggggccctgaccgccggaaagcccggtgtggtacacatccatatgggcagcggaaaacggggactcggcctggtctatgacttgctggaggccacggatctgcccatctggcacttccgtcccacccacatgagccgttggcagagcgaggccgcggcgtttgcccggaagggcgggatggtggactttactgccaatgccgacccagaaaagtgcgccctgcctgtgctgcgcaccatggaggaggcgccgctggaacgcattaccatcagctccgacgccggagggagcatgccgcgatggtcggaggatcactgtaccatgctaggcatgggggtgggcaagatggacaacctcctccccaccatccgctgtctggtgcgggagcaccgagtcccgcccgaacgggccatccgtcttctgacgcagaatgtggccgatgggctctgcctctcacgcaagggccgcctaacagtgggagcggatgcggatgtgctgctggtggaccgggactggaacatccacacggtactggccggcggagagatcatggtgtcggacgggcaggtggttaaacaaccctatatttcttaagaaagcaagtggacggcatttgtggcggactacccctttaaggcggactccatggagcgtgagtggcgctttaccctgaccgatccgatttggagtgtaaccagggcgcgtttcggctgtgcatctccccaaacggccaggggcgggggagcggattgcggaaccgtgcgccgaccagatcagtattcagacgatgaccaccatgctgatgggatataagcgcccggactacctggccaagatagggcgcctgaacgctgacgaagccaccatcgatatgctggaggataccattgagcagcaagcaccctatatctccgactatttttaagaggacgcgtcgcttggtgccctctgccttaaaaaagcatttgcgtgcgcaattgaccgcgcacacaaatgcttttttagcctgtcctacggcggaaccgggcgattaaaccagaagaaaagagcggggagagaatttctcctctccccgcttccgggcagatgttacgccttgccgtcgcagcccagcacatggatgagcttgtgcttgaccatctccttgatgttggcccgggcgggcttcagatactcgcgggggtcgaacttgtcggggtgctcggcaaagaactggcggatggtgccggtcatggccaggcgcagatcagagtcgatgttgatcttgcacacggccagacgggcagcctggcggagctgctcctcaggaatacccacggcatcgggcatcttgccgccgttttcattgatcatctttacgtactcctgggggacagaggaggagccatggagcacgatggggaatccaggcaggcgcttggagacctcgtccagaatgtcgaagcgcagaggcgggggtaccaattcgcccttctcgttgcgggtgcactggtcggcggtgaacttgtaggcgccatggctggtgccgatagcaatggccagggagtcgcagccggtcttggagacgaactcctccacctcttcgggatgggtgtagtgggactcctcggcggagacctgcacgtcgtcctcaatgccggccagcgcgcccagctcggcctccaccaccacgccgtggtcgtgggcgtactcgaccaccttgcgggtgatctcgatgttctcggcaaagggcttggaggaggcgtcgatcatcacggaggtgaagccgccgtcaatgcaggacttgcaggtttcaaaatccgggccgtgatccaggtgcagggcaatggggatctcggggcactcaatgaccgccgcctccaccagcttgactaaataggtgtggttggcataggcgcgggcgcccttcgacacctggagaatcatgggggcgcgaacctctctggccgcctccgtgatgccctgaacaatctccatattgtttacattgaacgcaccgatggcgtaaccgccgtcataggcctttcggaacatttccttcgtggtaaccagtggcatagagggctcatctccttcgtttatttgccacatgattctatcagttttcattgccaattgcaagaggacgtgctatgatatttacgcaaaaaccgctaggttcaccaaactaaactacggtcagggaggtacgattcatgagtgaattgagaggagcctgcatcatcgggcagtcgggaggccccactgcggtcatcaatgccagcgcgctcggggtgatccgcacggccctggacacggactgcatcacccgggtgctgggggcggccaacggaatccagggcgtcctggaggaccggctgtacgatatggggcaggaggatgccggggagctggagctgctgcggtacaccccgtcctccgcgctgggctcctgccgctacaagctggctgatcccagccaggatgacaccgactaccgccgtattctcgagattttccgcaagtatgatgtgcgctatttcttctacaacggcggcaacgactccatggacacatgcaacaaaatctccaagtacatgcagtccgtgggctatgcgtgccgcgtcatcggcgtgcccaagaccattgacaatgacctcaacggcaccgaccactgcccgggcttcggctccgcagcccggtacatcgctaccacctgcatggaggtccaacgggatacccatgtgtacgacaacggaaccattaccgttctggagatcatgggacgccacgccggctggctggccggctcggctgctctggctgcctgggcgggctacggcccggatctcatctaccttcccgaggtggattttgacatggaacgctttctggcggatgtccaccaggtctatcaggcgaagaacaagtgcctgatcgcggtctctgagggaatccaccgggcggacggcgccttcatcgccgaaggagtttccgccgccgccaacgacggcttcggccacacccagcttggggggctggcggcgctgctggccgaccttctccggcagcgggagccctccgccaaggtgcggggcatcgagttgtccctaccccagcgctgcggcgcccacagcgcgtcccagaccgacatcgacgaggcgtttctggcgggcaaggcggccgtggaggctgcggtcgccgggtattccgacaagatggtggccttccggtgcacccgggagggaggctaccgctgcgagactgtgctggaacccctggatattgtggccaacgcggaaaagacggttccccgcgcctggatcaacgccgatgggaacggcctggagcagcccttcatcgactacgtgctccccctgattcagggcgtccctcgggccccgcaggaacactccctcccccgctatgcacggctgaaaaaggtgctggtctctcaggaggcgtaaaacttgctgaaaaagcggccctgtgcaaatgcacagggccgctttttatctggctcagtccaggaaatctcctttgaaaaagttctcgtttgccagtttttttgccgtcaggcgaaagagaacgcagccgtcggggcacacaatatccttgcaataggggccgcttccgcctacgttttccagatcgccgccgcttcggacggcctccatgagggggaaaagcagtagcatggccttggagcagatcccctgcccgtcctgattgaccgggcagccataggtacaggtataccggtctccgacctcctctccgttgcggcaataccgctcagtatggtcgccccggaggaagccggttacctcgacctgaaactcgtactcctcatcgtaccactttttcatgcccgctctccgctcaatgcacgccggtgagggcgcgcatgacctcataggtgtgctgatccagactcttggtcatctggagggcctcggtgatgtcatagtccacatagttctccccctgaagggccaccacccggcaggtcttgccctcggccagcaggcgcaccgcctcataacccatgtaggtagcggtgatccggtcgcgggaggagggagagccgccccgctggatgtgtcccagcacagtgacacgggtatccagggcggtagcctcctcgatgaccttgccgatggagtaggcgccgccctctacgccctcggccacgatgatcatgaagtgggtacggccggccagacgggcccggcggatgggctccaacaggtcggcttcatagtccacagggtgctccgggacgatcacggcagtagcgccgcaggccacgcccacggtaagggccagatggcccgcccggtggcccatgacctccaccacggaacagcgctcgtgagactgcatggtgtcccgcagcttgtcgatggactccagcgcggtgttgcaggcggtgtcatagccgatggtatagctggaacaggcaatgtcgttgtcaatggtgccgggaatgcccacaacggaaagtcctctcttggccaggcagagcaggccgctgaaggtgccatcgccgccgatgcccactagggcgtccagccccagcatcttgcaggtagccaccgccctctcctggccagcgggggttttgaactcctcactgcgggcggagtagagcatggtgccgccccgacgggacaagtcgcttacgctctcaaaggtcagcttggtgaaatcgccgttgatcagaccgtggtagccccggcggatgcccacacattcaatccccatgtgcagagaggtacgcaccactgcccggatggcggcattcataccaggggcatcgcctccgctggtaaacacgccgatgcggcgtactgctttttccatattcaatatcctcctcttaaaccttcagttccgtctctttgccctgtagggcggcagcatagcgctccaacacgggctggacatcgtgagcaaggaaatcctccacctgctgcgggcagcgcccaatatagcgggccggctccaaatgggcggtcagctcctcccggctcagcatggagaaagccgggtcggcggcgatgagctcgattaggttgttgctaaggccgcagtcctttacgttggctcctgcctcctgggagagcacgcggatacgctcgtggagctcttgccggttgccgccccgcttcacagcgtccatcaggatgttctcactggccatgaagggcagctcctcccgcacgtggcgctcgatcaccttctcatggaccaccagtcctccggccacgttggcatagatgctcagaatggcatccaccgccaggaaagcctcgggcacggacagacgcttgttggccgagtcgtccagagtacgctcgaaccactgggcggaggcggtgaccgcagggttgaccgcgtcggccatcacatagcgggccagggcgcagatgcgctcgcagcgcatgggattgcgcttgtagggcatggcggaggaaccgatctggtttttctcaaagggctcctccacctccttcaggtggcagagcaggcgcagatcggtggcgaacttgctggcagactgggcaatgccggagagggtggacaacaccgcatagtccatcttgcgggaataggtctgacccgaaacgggcaccacggcgtcgaagcccatctcggcggcgatcttccgctccagcgcccggcatttctcatggtctccctcgaacagctccaggaaggatgcctgagtgccggtggtgcccttgctgcccagcagcttcagagaggcgatgcggtgctccacctcctccagatccatcagcagctcgttcatccagagggtggcccgcttccccaccgtcaccagttgagcgggctggaagtgggtgaagcccagggtaggcagggccttgtactgctccgcgaactccgccaggcgggccagcacctgtaccagcttgtcgcgcaccagcagaagggcctcccgcataaggatcacgtcggtgttgtcccccacatagcagctcgtggctcccaggtggatgatgggcatagctttggggcacgcctcgccataggtgtggacgtgtgccatcacgtcgtggcggagcttcttttcatacgccgcggctttgtcgtagtcaatgtcggtgaggtgggcctccagctcgtccacctgctcctgggtcaccggcagtcccagctccatctcggcccgggccagggcgacccacaggcggcgccaggtggaaaatttcttgtcgggcgaaaagatatactgcatctcgtcgctggcgtagcgggaggacagcgggctctcataacggtcgtgcatgcaaagacctctttctcctcagatttcactggctagaatatcataaaacgggggcggacacaagttccgccccctgtttttgccgttgtcattccgccaaaaatttttccagacggtccaggccctctttgatattttccatagaagtggcgtaggaccagcggacgaagttgggcgctccgaagccggagccaggtaccaccgccaccaggccgtacttcaggaaggcgtcggcgaacacgtcgtcattggtgatctccaccccgtgaatggtcttgccgagaagctgctccaggttcatcatcacatagaacgccccctccggctggatgcagctcacgccggggatggcgttcatccgctccacaatgtagttgcggcgctgctcaaaggcctggcgcatggtctcaatctccgcttgggaaccggagagggccacggcggcggccctctgggagatggccaccggagaaccggtggagtggctgacgtaattggccatcaccttggcgatgacgtcgttggcgcaggcgtaaccgatgcgccagccggtcatggcgtatgccttggatacgccgttgaccaggatggtgcgctccttggcgtcggcgctgagggaggcgaagctggtgaaggtgcggccgtcgtaggccaggcaggcgtagatctcgtcggaaatcacataaatatccgcctgggtacacacagcggcgatggcctccagctcctcccggtcgtacatcatgccggttgggttggagggattgttgagcagaatggccttggtcctgggggtgatggcggcagagagcttttccgctgtcagcttgaagtgctctgcctcggtggcggtcaccaccaccggcacgccgcccaccatcttgatgagctcaatgtagctcacccagtagggcgccggcagaatgacctcgtcaccggggttgaccactgcccgcagagccaggtagaccaagtgcttggcgccgctgctcaccaccacttggctgggcttgtactccagtccgtagtcggccttcatgcggccgcacaccgcctgacgcagctccaccgtgccggctgcgggggtatagcgggtgacgttctgctcaatggccgcaatgccggctgccttgatgttgtcaggggtgttgaagtcgggctcccccgctccgaagccgatcacatccacaccgtcggccttcatctgcttgaacatggcgtcgatagccatggtggtggaggcctgtacggccgatgcaatcctggacagctctttcactgaaatcgctcccttgtactttaaaatcgtattttattatatgcggctttgcgacgttttgcaagtccttaatcctaaaaatgcaaaatcggcgcctgccgactggcagacgccgataaactcaggagtggctccgggcgctgaccacgcggacaatcaccgtgctgagcaccaggttaatcaacagttccagaacaaaattgatgctgaccatagtaaagatcatataagtaatgaccgtctgcccagcaccggtggcccatgcctccaaataggtcgggaacaggaaaaacagacccagcaggaacaggccggtattgaccaccgggctgacgatgccagcggcaatggagccgcccagcatacgaccgctgctgtgggatttgccgccccaggcgatggcccgatagaccaggccggcagccagaccggccaggatgcccttgcccaagcagaccaaggcggtcaggaagggattggcattccacaggatcgctccaccggggtcccagcccaaaatgcaggccaacaatacgacggcaccgaataccccgcccaggcacgcgcctgccttcgggccgtacagggctgcgccgatcaggatcggcgccagggccagcgtgatggtgaaggggccgaacttcacaaaactggcgactacctgcaggacaacaataatggccgtcatcagggccagtccggtcaggcgtctggtcttttcgcttgctctcatatgaaattacctcctgctgccgctccttacctggaaggatgcagcgcaatttatttacccacggcagacagccgttgagtacaaaaaatggcgtggccggtcacgctttccggtacttttttgcgtttttctggtagagcaaataaagtccggtcatgatcagatcggcgtcatattgaatgggacgcttgcagtagcgcagaatccgaggggcatttccgccagtggccacggtggtgacgctttggcctatgctctcctcaatgcgctccagcatcccgtccaccatgctggcgtgtccgtagagcacgccggagcgcatggcctcctctgtggtgtggcccatgaggcccaccggggaggcggtttcaatggagataggcggaagagcggccgcccgctccgacagagcgtccagcgccagggccagccccggcataatgatgcagccctcgtatacgctgcctacaatgagggacaaagaggtggccgtacccatgtccaccatgacaatggggcttggatatttggcgatcgccgccaccgaagaggccacgatgtcactgcccaactggttgtggatctcggccttgatgttcaaaccggtcctgatgccagggcccaccaccatgggggggatgccggtcaggcgggcgatggcatcggtgaagatggtagtcagcggcggaacgacgctggagaggatggccccgtctaccgtgcacgcatccgccccatagagctgaaagacgcccaggagctcgatggcgcactgatcccgtgtcttgctgcgggaggtctccagcagggcgcggaacaataactcccctgtaccgttgaacaggccgaccgtcgtattggaattgcccacgtctaccgccagaatcataacatatccccctccccacaaatatttttattattatagcaataaatacagcgaaagatcaagctggtatctgctgttcctaccccttttcggagcttggaactgtgttcaggagtttggtcaagtctcctatggaggcacccattttgaccgaaacctcctccatagtcatgccggaagccagaaaacggcggattaccatccccatgtcctcccccacttcaatgaggtgcccatctggatcgtaaaagcgtgccacccgctggccccagtcgtgttcgatgatgccgccaagccgttctatacccggataggcatccagcttttcaataaatccatcaaaatccgtctcttcaaagaccaattccatattgttgggctttttccgcacgtgcatactcggcactccaattagccagtcaaaatcctgttgcagcgccagcccacaggtaaaggcaatatttctcccgtaatcctgggccacctccagaccaaacaattcctgataaaacgcttttgcagcgtgaatgtccctgacagacagaagtgcgcagatatatttcattggtttgttcccctctccgttaaaagatagagccagtataccatatgcagtgggcaaacacaagaaacagggcagccttttgttcccccctcacaggggtaacaagtaattcctgggataccccggcaggtcatcgtgtttacgatgcctgtcggggttcttctgttttccggggttgcaggctttccatgtcttgctgttggctgtccacgaagccgatgccgttgtagtaaatctccacggtctgaggcgcgtgtttagaccactttacctctttttcgtgaaccacgatcttttcaatgaacagccgcagcagttccggtgtcagttccgtaatgtctgtgtaccgcttcgccttgtcaaggaagctgtccgtcccgctcacagtttcccgcaggcgctggatctcattctctttctgtggaatgccagcggtgatacagttctgttcttccgtgtagctgccggacagcatctggaattgttccgttgtgatgcggcccagcacgctgtcctcatacagcttcttgaagatggtgtccaattccattttccgcttccgcatggcggacagttctttctcctgcctgcgtatctcccgctggatctcagccgactgcctgctgccgatataggcggcaaattcctccgggtgttcccgtgccatggccgttaccctccgcagatcctccagcaccacctcatccagaacgcactctcgaatatagtggcctgtgcaggcttcaccatcttttttgtaggtgcggcaggtgaagtggttataactggcggatatggtatgcgcccggtgcagcaccatattagaaccgcagtcggagcagaacacaaggccggagtacctgttctgctcatccatattggttcttcggcgcttgttctttcgtacccgctgcacaatgtcccaaacttcttgtgtaacgagagcgggatgggtattctcaaacaccaggcattcttctctggaatgctccacccgtcgcttatccttataggacttggtgctgtatttcatgttgacggtgttgcctatgtagatctcattttccaacatatccgctactgtatccccagaccagtgatacgggcgctgggtatccaatcccgtatgggtcatgttgtgcttggtataggcatacatggtaggcgtcagcacctgttcttttttcaggattctggcgatctggctggggccgttgccactggcgcacatggcgaaaatcctgcggacgatggccgccgcttcctcatccacctccagcttctttgtgtctgggttcctgatataaccgtagggtgctctggtccccagccattctccacgctccgctttggccttcagcaccgcacggatcttccggctggtgtcccgaataaaccactcgttaaacaaattcttgaacggcatgaggtcattgctctcgctgctgtcggtgtccacattgtcattgatggcgatgtagcggacgccgaacatgggaaagcgttcctcaatgtacaggccggtatgaagctgatttctaccgaggcggctgagatccttggtcacgatgatcccgatctcgccgttttccatgtctgagatcatctgctggaacgccggtctttggaagtttcctcccgaaaaaccgtcatccacataaaagcaggggctggggaaatggtgatcttccgcgaatttctgcaaaatggctttttgattctggatcgagttggaatcgccctctatcccatcgtcctggctgagacggcagtaaagagcggttttcctgatttggtttgactgattcatacagtcctccttttctttgtcaaaccgttcagagcattgcgacaccacaataccccgaacggtctgaaatgtccagcactttacgcgcacagctttccctgccgaaagtccagttccgccaaggctttcagcttatcctccacggtttcgctgccatgccggggaaacacggagatgactcgaatctcccgcccgcaggctgtctgcatccgctccacggtgatacgatgattgtcgatggtaatattggctttttgctccataggctctcctttttcgattgtttactgagtttgcccacacgccgcctgtgggggcctctgccggaggggatgggcagggacgctgcccattgcggaagaacgccgcacggcgcggcacagggcgaatgggcgggtatttaccaacggctttgaacttctaaaccgctttcgacaatgttgccgaaagcggttttctgttttttcagataccccctcactacccctcccgaaaaaacagcgtggtgaataccccggaatcaaaagttcctgcaaaagatttaaggtcaagggtgtgcaatagacaccctcgccgtccagtcaagggtgtcttattgacacccaaagcgaaaaaaatcggcagacaggctcttgtaaagtctgtctgccgatggtaacataccgcaaatcgaagaaggaggcatggaacataatggctgctgttttatcgctggggctggcgctgctgggaggaatcatctgtctggcgcagacgctgcggctgtccgtaccgctgctgtatggagcattggtcatcacagtatttcgcccgtggtatctggcccataccgctctggcggacgggattttccttgtgctggtggggcttgcggcgctttcctgggtggtgacgctgattcgagcggtgcgggagacgatctggtaaagtaagggttggcaagattgccaacccttacttttagacaactttgtcaaaaagtctgaccgggttcggtgatttcaccgaacccggttttcagcgtctaccgcttttgacaagattgtctgaagcgctttagggcagtccgctgtgatcgggtttggcaatgtgccaaacccgattttatatgctactttccggcaatgctgccgagaagtttccgcccgcgggcggcatgggggactgggggttaccccagcaagcgcgtttgtcatacaaacgctatgcttgcgccaacgccgccacaggcggcaggggctttttgaatagtgccgataatactccttatgagaaaatcggcgatgaagtgcggtcgttggcggatgaggtgccgttcgacatccccgattcgtgggaatgggtgcgtattcgttcgttgggtgagattgtgcgcggaagcggtattaaacggaatgaaacagtcccgcaaggatgtccatgcgtccgatatggagagctttatacaacctatcagacatcgttcacttctgccgcttcattcatctctgcagaactcgacgaaaaatgtaaacatttttcctatggcgatgtgctcatgacactcaccggggagaataagccggatattgccaaagcagcagcgtatttaggaattactccaattgccgctggcggagatcttgccttttggacacagcacggaatgaatccgctatttctttcttatattatggcctcaccgtatattatcagccgtaaggtcgcattagcgactggggatataatcgttcacatctccggagataagcttggaacaattcttctccccgtaccgccacttgcggagcaaggaaagattgtagcacgaattcagagccttgaattggttatcagtgattacgccgaaaaagcggctgcgctgcaggttctggaagataccttccccgaagccctcaggaaatcgatactgcaagaagcagtccggggcaagctggtacctcaagacccgtctgacgagcctgcagaggctctgctggagcgtatccgggcagaaaaacagcggctcatcaaggaaggcaaaatcaaaaaggacaagcacgaatccgtcattttcagacgggataattctcattatgaaaagcgtggctcggatgaggtttgcatcgacgatgagatcccgtttgaaatccccgaaaactgggcttggtgtcgggcttccagtttaggaacaatggtcagagggcgtggcatcaaacgaacagaaactgttgcccaagggtgtccgtgcattcgatatggggagatatacacaacctacgaaacctcctttgatacggcagtttcctttgttcctgaatcgctcgataaggattgcttgcatttttcttctggcgatgtagtgttcacattaacaggtgaaaacaaagtggatattgctaaaacggtggtgtttctcggaaatggacaaattgcggcaggtggcgatttggctttctggacccatcacagaatgaacccgctgtatctggtatactatatggcttcgccgtactgcatcgagcttaaacgcaggacggcgacaggcgacattatcgtacacatttcgacttcaaaggtcggcgatttccttgttcccgttcctccgcttaatgagcagaaccgaattgtatcggcgattgaacagctttttgatgtggtttctactttgtaaagttctcattatgagaagttagacggaattgagcgttgtattgacgatgagataccttttgacattccggacaactggagatgggtacgttggggaaatatttcagaatctatccagtacggttacaatgcacctgcaaaagataagggtcgtataaaaatggttcgcataagcgatattcaaaacaatattgttttgtgggatacagttccgtattgcgaaattgcagaaagtgatattggaacgtaccttttacaaaccaatgatattttatttgcaagaacaggagggactgttgggaagtcgtatcttgtacaagaagttcctgaagaagcaatctacgcaggatacttaatcagaaccagatacagccaatggctatgccctcaatatttgaaatttttcatggaaagcgaattgtattggagccagctgcgcaatggcactatagcaacagcgcaaccaaactgtaatggcaaagcattaggaaaaatgttattgcctattccaccattatctgagcagtatagaattgtcgaaaaggtcaatgctttgtttgattattgcaattcgatatgaagtaaaaggcatacacctcaaataattgaagtgtatgccttttcttttaccaatctatgattgtatcaacgatttctcgctgttctgtagctgttttcctaaggtagatgcgggtggtttcgatgctttcatgccccatgagatcagccaggaacgctatgtcattacagcgatcaaggaagctcttggcaaatctgtgacgaaaggaatgcggatacacaacagcagggttgataccgtacttcactgccagctttttcagttgcccagagataccacgggtggtaatgcgttccccatatttgttcaaaaaaatgaagccactttcctgttgcttatcagccaaccaagaaagggcttcattttgtagctctttggggatataaattctgcgcaattttccgcctttggagtataggtcgagatgccctaacttaacatgttcagcctttatctgaatcagttcgctgactctggctccggtggcggcaaggaagcggattacgaaataccagaacatttcatcgtcattcttcagacaagatttaaagtatttgtagtctgcttcactaatgacattttccagaaaagttttctgctgcacacggacaaatggcagtttccatttttctttgccaatgcactctaagtagcagttgatggctcgaagtctgagattaactgtcttgggcttgtaattctcgatcagccataccttgtactcacgtaactttttctgggtgacatcatcgtattgatccccatactgtttgatggcaaattgatacgatgaaatcgtgttttccgagaggttcgtgcccctcaaatgtctttcaaatttttctttttctatcatggcgaaagacctcctttcgccagatattatacaatcctgcgttaaatcagcgtaatcttattgaacaattcctcaattttactaacgatgcgttcttgctcctgcatgggtggtataggaatcagaatcttacttaattcatcctgatttattttgggcattttaactcggcttgacatcgcagttgctacttgcagattgaaagcatcggacaacatatatctcaaaagatattttctatttattgccgtattcagtgggtacatatctgcactacacaatccatcaaacggagcaattaccgcttttcgtaaaagcggacgaatttttgagtaaataatttgccctttataaaacagatggtttggacttactaccttatcttgctgcaccgtatgacactcaaaaagagtccctgttgctttttcaatgttatctggggcgatatgtatatagtcggcatattcctctggacgaaccaggtttgttgctatgtctaccactgaaaagaagcgaacccattcccaagattcgggtaagtcaaaaggtatctcatcgtcaatacaacgctcaattccgtctaacttctcataatgagaattatcccgtctgaaaatgacggattcgtacttgtccttcttgatttcaccttccttgacgagccgctgtttttccgcccggatatgttccagcagagcctctgcaggctcgtcagacgggtcttgaggtaccagcttgccctggacggcttcttgcagtatcgactttttgagggtttctgggaaggttgaatttagggcctcgtttttttggtacgccacgtcgtatgcagaaacagcagaagcaacctcatcaatcttctcaacgatacgccgctgctcctcaagtgggggtattggtactaatagagaggtcattgtttctgtgccgactctgggcatcttcactccataggtgatgctgttaatgagattatcgacataaggggatttcagataattgacgatgtagctcggatcgattccaccgtatacacggaatggtacgatttccggcgtacaaatgccgtcatctggggcgacaagaattttcaatagatatgggcgtagcttgctgtagagaatgtcaccctttgtaaatacggtcttatcaccaactgctttgcgttcaccgactgttttatactctaaaagtctgccgcccttttcgatgtcctctaaatccagtccccaaatcgaaggatcggcacttgttgcatttactttttgctttgtttctgcataggatgaaatattgcctagccgcacccattcccacgaatcggggatgtcgaacggcacctcatccgccaacgaccgcacttcatcgccgattttctcataaggagtattatcggcacctttgaagataacggacgggttcttttcacgcttgattttcttttctttgatgagccgctctttctccgcacggatacgttccagcaaaacactggcgggctcatcgttcgggtcctgcgggacgagcttgccctgaacagccatctggagaatggagttttttagttgctgtgcagtcattcattgccctcctccgtaatgtcgataccgaggatctcagtaatttgcgcaaggatgcggtcaatgtctgcattcaggctggcccgtttttcctggtactgctggatcagttccttcggcggcaggatttcctcctcttcatgaggatagccgcagaggtcaatgttataactacgagctttcagttcttcgacggtatatttctttgccttatcgaaaccgtcaatggcgatctcctcacgattatcccaccacgcaacagccggtgcaaagtgctccagcttcatgggcttcgtcttggagaagttcttgtatccttccggcatatccagacggtagaaccatgtttccgtcgtgggatgagtccggtcaaagaacagtatatttgtcgtgatggatgtgtacggcgcaaacacgctgtgcggcatacggattactgtatgaagattgaactctgacagtagcttctccttgattgccatttttgcattatctgtaccgaacaggaaaccgtccggcaggataatggcgcaccgaccgttctgcttaaggcgatacataatgacagacataaagaggtccgcggtttcgctactgcgcaggtcagccggaaaattctgcttcacgccctctttttcattgccgccatagggaggattcatcaaaatgacatcgaatcggtcgctctctttgtactcgcgcacattcttctccaggctgttaccgtggatgatacgagggttgtcgatgtcgtggagcagcatatttgtggcgcacaaaaggaacggaagcgcctttttctcaatgccatagacggagttgctgtaaaccgttctgtcttcaacgctttgtacttggacatccagcaccttcagcgcagaggtaaggaagccaccggtgccgcaggcaaagtccgcaatagactcgccgagcttgggcttgatcatctgcaccataaagtccgtgacagcacggggcgtgtagaattcgccggagttaccggcgctttgcaggctgcggaggatcgtttcgtaaatttctccgaaggcgtgccgatcctcgtactcctcaaaatcgatctcgtcaatgacattgataacctggcggagcaggataccgtccttcatatagttgttattgtcctcaaaggccgtgcgaacaatgatctggctcatgggagtgttctcatcgatttcaatggccttgagagtcgggaacagttttccatttacaaaaccaaggagtgcatcgccagtgagcgccttgccgtccttatggtcaacggcccaattacgccagcgcagttcctccgggatgatggaggtgtaattctcgtcgtaaaactcccaaatctcttccttggcgtcgtacaccttcaaaaagagaatccaaaccatctgctcgatacgctgggcatcaccgttgatgcctgcgtcattccgcatgatgtcctgcagccgttttaccaggttatttaaactcatatcttatatctccttatgcagcgtagatttccttctgcaaatcacggatggcttgaatgtatccgtttttgccgccgaacagctttgcaatcttcatgggtgtgccaaatttgcggaacgggtcattcgacaggatttcgaggttctcgatgtcctgaatgccctcgttcatgtatttgtccagcagcgcactcagaacttcctgtgccaagccggaatacttgtaaaggtatccacgcttgcggacattatttgcccgctcggtctttgtcagcggagccttatcataggcaatgtggcagatgaggtcaaagtcatcaatatccttgttcccggcgatttgccgcagtgcctccaaaaggacaccacgctcctgcagctcgtcaataatggcttgtttcttttcttcggaattccaggcgcggaggaaggagtccaaagtagcatattcgccaagaatatttttctttgagtaatctgttacgctttccgtgatgagcttgccgtccttgtcataatattggacacgctcgtttagaatcgtgacctccacgccacgaacacggaatttgtgtttcttttcaggcggatcatcattattcccaccggagccgggcgtcggcacgggcggcttcggcggatcaattgtaggctcttcgccgttgccatcgccgtcattgataaccgaaatcgggtcaccatcaaactctgggtccgcaaaaagacgacaggcgttacgaaagtccatgatggtaaaatactctttgccgtaatcaggcttaagacgggtgccacggccaatgatctgcttgaattcagtcatggagttaatattgttgtccaaaacgatgagccgacacgttttacaatccacgccagtcgtcatcagtttggaagtcgtaacaattacggggtatttgctgtcctcggcaatgaagtaatcgagttgagccttgccttctgcattgtcgccagtaatacgcatgacatactttgcgttctccgctacaaggtcactattctcattcacgagggcctgacgcatccgctcagcgtggtcgatatccacgcagaaaacaatagttttagcaaagcggtcgttctctttcaaaaagcgggttatgcgctttgctacagctgtggtacgctcatcgataataaggtttttatcgtagtcttttgtgttgtactcgcggtcatcgatttcatacccatagatatcccgctgtccagctgtgggacgccatccttccagatctttatccaagccgacacggaggaccttatacggagcaaggaatccatcatcaatgccctgtttcagactgtatgtatagattggctcgccgaaataggagatattggatacctcttttgtctctttcggtgttgctgtcataccgatttgtgtggcactgtggaaatattcgagtatcctgcgccaacgagagtcctctttggcactgccgcgatgacactcatcaatgacgataagatcgaagaaatccggttggaaagcacggaatggctcctcgttttcgtcaccagccagttgctgatagagggacaaatacagttcataggagctgtccagctttttcccttcaattttcgtcataacctttgcaaacggcttaaagtcctgctgcatggtctgatcaacaagaatattacggtcagcaaggaagagtatctttttctttcgcccggatttccagagccgatgaataatctgaaatgccgtataggtcttaccggtaccggtcgccataacgagcaggatacgattctgcccatgggcgacggcatctacggtacggttgatggcaatacgctgatagtagcgaggagttttgtcgcccggctggaaataataaggttcagtgatgagttcctcctgctccggtgtaaaatgctcgtccccaatgtgtcgctgccacaaatcttgcggtgaaggaaactgctccagcgtcaattcacgctccttgccggacttcatatcatgttctaagaagccatcgccatttgaactgtacacaaatgggatgtccagcacttcagcgtattcaatggcctgctgcattccagcgccaatactgtgtttattatctttcgcctcgacaatagccagcggaatattgggcttgtaataaagcaaataatctgtgcgctttctcttgcctctggctgtaacatttccccggacgatgacacgaccatccgtgaaattatattccatcttaatttgcttaagtttgtcccaaccagcaccctcaattgccggagtaatatactgcaatttgatgtcttcctcagtcatctcttgtttcttcataagttcgctcacggtgatcctcccttcaacttccgataaggtgcaattatgagaactttcatttgtgagtagattgtaccagattgatagcctgttttcaacgaaaaagccactggcttcgaatagtccgaagccagtgactttttaatgctacttgaacggcgatttgttgtgttgtccttattcgtggtgaccttttggctgccctgttttcatccaatatgacggcagatgagctcacccatcttttgggtgccgatgggggtgacgcccggcccggcgatgtcgggggtgcgccagccttcggtcagtaccgcgtccactgccgcctccaccgcgtcggcctcggcggccaggtggaaggagtagcggaacatcatggccaccgacaggatggtggcgatggggttggccttgtcctggcctgcaatgtcgggggcggagccgtggatcggctcgtagaggccgggggcggtatcgccgatggaggcggatggcagcaggccgatggagccggtgaccatgctcgcctcatcggagagaatgtcgccgaacatgttctcagtaaccaccacgtcgaactggccggggtctttcacgagctgcatggcgcagttgtccaccagcacatcctcgtactgcacgtcgggatactcctccgccagccggtgcatgacggagcgccacaggcgggaggtttccagcacattggccttgtccacactggacaccttcttgcggcggaggctggccagctcaaaggcccggcggccgatgcgctcaatctcctgctcggaataggccatccggtcggcgcactccacgccccggtcaggggtgtcgtaccgctcccgctggccgaagtagatgccgccggtcagctcccgcaccatcatcaggtcaatgcccttctccgcggtctcccttttcagaggacaggcgtccgccatagcggggcacagggcggcggggcgcagattggcatacaggcccagatcctttcggatggccagcagggcggtctcgggccgctgctcggcgggcttgtcggagccccacttggggccgcccacagcgcccagcagcaccgcgtcgcaggcccgacacttctcggcggtgccgtcgggatagctcttccccaccgcgtcggtggcgcagccgcccagcagcacctcctcataggtgaagctgtggccgaacttctggccgacggcctccagcaccttgacggcctcccccaccacttcggggccaatgccgtcgccgcggatgagcgcaattttataattcatttcgccgcacctctcgccttcagggatttgagcaggccgccgttgtccacgatgccctggacgaaggcgggcaggggcgcggcctgataggtcttgccggtggtctcgtcggtgatcacgccggtgctgaagtccacgctcaccgtgtcgccggcctggatgccctccgccgcctcggcgcactccagaatggggaaaccgatgttgatggcgttgcggtagaagatgcgggcgaaggaaggcgcgatgacgcacttgacgccgcaggccttgatggccaggggggcgtgctcccgggaggagccgcagccgaagttggccccggccacgatgatgtcgcccggctccaccgtggaggcgaagctggtgtcgatgtcctccatacagtgggaggccagggacttttcatcgggggcgttgagataccgggcgggaatgattacgtcggtatccacgttgtcgccgtatttgtaaaccttcattgccttacacctccatcagagcttgcggggatccgccacacagcccgccacggcggacgcggcggccaccgcggggttggccaggatgatctcggagctgacagggcccatgcggcccacgaagttgcggttggtggtggagatggcccgctccccgtcggagagcacgcccatgtggccgcccaggcaggggccgcaggtgggggtggacacggcgcagccggcctcgataaaggtctggatcagcccctctgccatggcgtccagggtgatctgctgggtggcggggatgacgatgcagcgcactccggcggccactttgcggcccttaagcactgccgcggcctggcggagatcctccagacggccgttggtgcaggagccgattaccacctggtcaatgtgggtgcccgccacctgatccacggtgcgggtgttggagggcaggtgcggcagggcaaccgtgggctggagggtatccagatcgatgaccacctcccgctcgtactcggcgtcggcatcgggctccacggcctcccaggggcgggtgacccggccgtccagataggcccgggtcttgtcgtccacggggaagatgccgtttttggccccggcttcaatggccatgttggcgatggtgaagcggtcgtccatggacagggaggctaccccctccccgccgaactccagggacttgtaaagggcgccgtccacgccgatggtgccgataaggtggaggatcacgtccttgccggatacacagggctggagtttgcccttgagggtgaccttgatggcggaggggatgcggaaccaggccagccccgtggccatgcccgcggccatatcggtggagcccacgccagtggagaacatgttcaccgcgccgtaggtgcaggtgtgggagtcggcgccgatcatggcctcgccgggggcggtcaggccctgctcgggcaggagggcgtgctctacccccatgcagcccacatcgtagaaatgggtgatgtcaaagcgcttggcgaactcccgcacctgggcgcagagctgggcggccttgatatccttgcagggggtgtagtgatccagaaccagcgcgatcttttcccggtcgaacacctgggtcagccccgccttgttgaactcggcgatggccaccggggtggtgatatcgttgcccagcaccagatccagcttgccctccaccagctggccggggacaacatgctccaggccggcgtgcctggccaggatcttttgggtcatggtcattcccatggttgggtgcctcctttttatttcagtggcaccagaatagcatggccccttgccaaaagaatgtaaagcgtgttacaattgaccaaacaggaggtgaacgcaatggcgcaggaccacatctgggcgccgctggcggaggggcagcccacccaccatcgggagccggggcagatgatctatttacaggacacggaggccgcgcagttttactatatcctcaccgggacagtgaagtgctttatcagctcccccgacggggacgagcgcaccctggccctccaccacggcggggagctcatcggcgaggcgtccttctttgaccggcagccacgggtctcctccgccgtggcggtcaccccgtgcgagctgatctcggtgaaccggcagcatctggaggcggtgtttgcccgccggccggacctggccatctccatgctggagtatctggcccgcacggtgcgcctgctctctggccatgtagacagcgcctttttgcaggcggacaagcgcatcgcccgccatctgctggccctcgagccggacgccaggggtctgctccactgtacccatgaggagatcggctcctctgtgggggtgagccgtgtaacagtgagccgggtgctgggggacttcgaccggcggggctgggtggagaccggctataagagcctgaagctttgcaaccggcaggccattgcgaattttctgaccgagggggtggggtgagcgtgggctggtatttcttactggcggcggccgggctggatctgctcctccccttcctgctggccccattttaccccggctactcccaccggcggcaggtcatgagcgtgctgggcagcccggaaagtccggtgcggtgggtgtaccgggtgtggctggtggcgctggggctgctcctgtgcgccgccacaccagacctatgggctgcctttggaaaccgctctcctgtcctgaccgggctgctgatcgcggtgctctgcgtgttcgccctgggggcaggggtactggccgggctgttcagcgtcaatgccgacaaagcggtggagacagcggcctcccgcatccacggcgtcggctcggttctgggcttcctggccctggcctttgctccccttctggtggcgctgctggcttttcgggatggtgccggcggggccggggtattctccctgatctgttttgccctcgatgtgtgctgtttcaccctctttgttatggcggacaaggaggcgtggcgtggcacccggctggcccaggagggcacatggcagcggcttaccctcctgtttatgtacctgccgctggccgttctggctgcctcacagctcattcagaaatagaccacgagggggcgtcccatctgggacgccccctcgttttacagaatgatgcagatcagtccgccggagccctcgttgatgatgcgctggagtgtctcctggagcttggcgcgggcgtcatcgggcatgcgcttgagcttgccgttcaaatcctcgctgaccagctcatggaaggacttgccgaagatgttggactgccagatggccttggtgtctccctcaaactcctgaagcaggaaattgaccatctcctcgctctgcttttcgttgcccacgatgggcgagacctcggtttcgatgtccgcacggatcatgtggatggagggggcggaggccttcaggcgcacgccatagcgtcccccctgcttgacgatctccggctcctccagtaccagctcgtcggtgctgggcaccacgatgccgtaaccggtggacttaacctcttccagcgccccggctaccttgtcatactctgttttgacgtgggcaaggctggagagcagctccatgagatcaccatcgtcgtggatggtgaagccggactgctcggagagcgtatcgtagaacagcccccggggcagctccaactgggcggcggccagaccggtgcccaggctgatggaggtgatacgggcgctgctgacggtgtcgcactccccaatggcggtgaccgtacgctccacatcccggatgcggtgcatcccggccgccccctcccggatggccgtatacaggccgctcttgatggggtggtcgtaaggcagggcgtccacccaggggggaaggaacagatccagctccttcaccgggaactcgtagagcacccccttgatgatggcggtcaccgccgcctcgtccagctccaggcagtcggcgcacacacacgtcacgtcatagcgggaggcgatgtccgcccggatggcctgtgcccggtcggaattggggtaggacgagttgagcaccaccaggaagggctttcccagctccttgagctcggtgatcacccgctcctccgcctccagatagtcctcccgggggatgtcggtaatggaaccgtctgtggtgaccacgataccgatggtggagtgctccgcaatgaccttgcgtgtgccgatctccgcggcctcggtcatggggatctcatagtcaaaccagggggtggttaccatgcgggggctgtcgtcctccagggagcccaccgcgccgggaaccatatagcctacgcagtcgatgaggcggacggagaaggccgccccgttgtccatggtgacctgaacggcctcctccgggacgaatttgggctcggcggtcatgatggtgcgcccggagccgctctggggcagctcatcccgggcccgctcccggcggtacacgttgtcgatgttggggatgaccatggtctccatgaagcgtttgataaaggtcgattttcccgtccgcaccggccccacgacgccgatatagatatccccctcggtacgcagggcaatatcttcatagatcttgcgttgttccacttgcgattcctccttcggccgcatgagccggtcgttttctctacatacctatggggataagccgtaaattatgcctcgtccccggagagaaccaaaaagcccgcccggcatttgccgggcgggctggttttaccgcttgcgtgggatgagcaggagctgcccctccggggccacgtcctcctccagcgcgttggcgcacatgatgtcctgtgcggtggtaccgtaagacttagcaatgtcccagagccgttccccgtttcctaccatacgcagaacaatggagggctggccggagtgatcccggggggtaccctcatccatatggaccgcagacacggcggctgtggtgcggctggtcatggccgtgtaccggaaacccaccgggaagcgcacctcaatgccacccgtcgtcggggtggcaaagacaggggcggtacagccgcagtggcaggagcaggacgcctcctcaggcagctccagggggcaggcggcctggagctgccgggtgatggaggtgcgggcgccgtcctccgtgaggtagagcaccgtcacgttggcctcggcggtcagcgtcacccgtctcccgtcccggctctgggtgatggcgccgatggtcacataggcgtccgacacctcctgggccagcatcccggtttccaggatctcccgcaccgtcagctccttctccccgtgctccaccaggcggcccatcgtataggtccggctctccgccgtaagctggaaggcggtagagtacacatctgtcagcatctggagcgtgcgctcctcccgcaccaccgcttgggccagcagccccatggagacgctgatggtgcggccgtcgccgctgtccagggcgcagtccaggccggtcaaaaccacgtacacatcacaggtagactcctcccccgccccggtgatctccatgatctgggagaagggcagctcgtattccgctgtgcacagtccgccggcggaggagcggtagagcatctgaagctggctctcccccttgaaaataagcttgtttccgatgaccttggactcactgcaccgcagggcagcgcggcacttcagcagctcttccgcctccggcttgctgccggacaggctgatttcatcagaaaatgtaaagggcttctcctgcacgcagactgtggtacaggcatcacactgctcagacatctgctgcacaccagcttcctccggagccagcactccgctgcagatgtcatcctccaccggggcatagacctgcacacagaaagccagatccacccggaccagcaccttgcgggggttgatcagccgggcgtctgccccctgtacccgcggcagggccaccacgcggcacagaggcgtcagcgccgggtgctccagagtacaggaaaagggcagttccacctccatccggcgtatcccctcttcaccgtccgggaggtagagcagcgccgcccgtaccgagccggagagctccacccgaccatcctggagcaccttgtcccgcaggcataccacgccctcggtatcgcagatgcgaaggatatccggacaggcatccggtacaatgctctccagtgtctcctcgcggcagacggttgtatccagtacggcctcatagccgctccgttgagtccgatccagttccagctccatagcgttccactccttgtacgggccgcagccctttttcatgcattctgctacagaactatatgtacaaggtgggaagactatgcccgtggctcatgcgccccggatgccgaaaatggtcttgagtattccgcgcagcgctttgggtgatttaaccacgacgatcttcatagcacagcctccctgtcgtcccaaattcgtttgagccagtctctgccccggctgcccgcccaagcacccgcaccaaaggcgatcagacaggccggatggagcagcagggctgcaccccccacgcacagcgctgccgttcccaggcgctttctggtttgtagcgtcaaaatggccgcctcctttcgcaactggttctgtaccagtatacgcaggaggcggccaagggttcccagttcattagacgcgctggctccggatcagcagggcgcggccggcggaaaggcagatctccacctcgtcgcccagcggctcattactcactgagagggtgtcgccgcgagtgagtaccgcgtcggtcagcggatatttgagtccccgcagggtgacgccggtcacgcggcgatccagaggaaccagagagaggtagtgatagcagggacggttggttagccgcagcactccgctgtccagcaggcgcacctcattatcggcatccaccaacagagcccggccgccgtggtcggcgatccactccagaagcaccaagttggaggcggtatggtccagccgtcccccagtacagccgcacagcaggagctcccggtaatccagctccagtgcctgatccaccgctgcctggaggtctgtcatatccttttccaccggaagcgtgatgcaggggacatcgctctccggcgcaccgccggagtcccagtcgccgatcagatagtccggccgcagtccggccgcacgggcgttgcgtaccccgccgtcggcacagaagaccgtccatccgcctccgtccagataagggcggagaaaggccccgtctccgcaggggactgagccgaaaagcagtgcgcgcttcatttccgttcccattcgggcacttcctttgcctgctgatacagccgtacatagctggcgtgacggctgggggcgatctctccagcctttaccgcagcaagaactgcacagcccttttcctttacatgagaacagccggtgaaccggcattgctccagataaggggcgaactcccggaaggtatattgcagttcctcagggcgacggagctctatctcctccgtgtcgaaggaggagaagccgggggtatctgccacaatggcgccggagcggagccgaaacagctccacatggcgggtagtatggcggccacggcccagcttgtcggagacctcccccacctggaggcggaagccgggctccagggcgttgagtatgctggatttgcccacaccggaatttcctgtaaaggcagaagcctttccagcaattgccccagagagctcctccagtccctcccctgtctcggcgctcacccggagggtggggaacccggcagcgcggtaggtctggtagagctcctccgccgcatccaggtcgcacttgttgatgcagatgaccggctggcagttccgcccctccgcaatggaaaccacgcggtcaatcaggaatgggtcggtaactggaatggcgccggaggcaatgactacgagctgatcaatgttggccaccgccggccgctgaaattcgttcctgcggggcaggatttcatcgagaatccccgccccgctatccagaggggtgaagatgaccctgtcccccaccaggggggtgatcctctgatggcggaactttccccttccgcggcaggcgaccagaaccccatctccgccgtccacgtaatagaagccgctgatggcctttaaaataatcccttccatcagccgaagttcatcatgcgggtctcggagagctgcccgtcaagatagacatccacttgctggaagccggttccataaagtgttaccacccggacgcctagtacggtctgtacgtcctcattgaactgatcctgcccgttgactgtgactcggacacggacagtctccttgtcggagctggccagatttaccgtatagctgatgggcttcagcgcacctccgctgcctggtgtgggggaaacctccgggtcggtagaggcccccggcgtgggagtcggggtgatctccgggtcgggagaggtggagggatctgcccctttgctcaggcgcagatggatggtggaacccttatcgacctcagtacccgtctggatggactgccagcagaccagaccctcggcgtagtcattgctgtactgaggctcgtcaaatacgaccaccagtcccagcgttccctcggccttagcgcgggcctcctgctctgtcatgccgaggaacgggataataacagaggtttccgtcttgacaccgctgctgactacaagagtgaccttctccacatcggccagatcggtctccgccaccgggtcggtggaaatcacatagtccttggttacatcctccgaggtctcctcccggataaccagattaccggcctcctcggtgaagccgagttcccgcagggtattgatggccagacgcttatcctgattcaccaggttgggcatccggttctcctccacgtcggtgctgccgctgccgttgctgatatcgacagtgatggtggttcccgccgcagcgttgcgtcccgattgcggatcctggttcacaatctgtcctttgggtaaagtgctgtccacttcctgaccctctacgacctggaattgagccacggttacgccgctgtccgcccgcgcatcctcaatggtcttacccaccagattggggacattgtagacagtctgccccggactgctgaagaaggagacccagagaaatacgccgatgccgactacaaacacggccactgctgcaatggccagaataatgggcagacgactgccgcccccatcccgccggtccggatagtcgtcatagtccacctcgtcctcaaggggaaccgcacggcttttgcggggcttcggtgtgggacgggcatagggctcctccgacgcggcccggctggcatgggccggctgggaacgcacggtgtgcggcgtgttggcgcccagaatctgagtgggttcgtcgccgtcggcgataagcagatcggcgggcgtatagtcgaaattgatgctgggattcttgcggaactcctccaggtccaccagcatggcgtctgctgatacatagcgctggttgacatccgaggccatagctttcatggtgatggcctccagagcctctgggatctctgggtcgatctcccgtggggagagcggaatggagttgatgtgctggatcgccaccgccaccggggactccccctcatagggcaggcggccggtgatcatctcatagagtaccacaccggcggagtagatatcgctgcgggcgtcgatatggctgccgcgggcctgctccggcgagatatagtgtactgagcccagggcctcctgggtcagggtggcctgggcggcggaggtgagacgggcgataccgaaatcggccaccttcaggctgccgtcccgcagcaccatcatgttgtggggcttgatatcccggtggataatcccccggctgtgggcgtgggagagggccttcatgatctgagtgatgaagtgcagtgcctcccgccaggccagcttgcctcccttcttctgcatatactgcttgagggtgatgccgtcgatgagctccataacgatgtaatccagctccgtggagtgggacacatcgtagaccgccatgatgttgggatgggagagcatggcgacggcctgggactcatcgtggaaccggcggcggaactcggcgtcctgagccagctcctccttgagaatcttcaccgccaccagccggttaaggcggtgatcccgccccttgtagaccacggccataccgcccgtcccgatgcgctcaatgatctcatatcggttgtcgagtaatttccctatgtactgatccatagttcattacccccttttaaacgatctgaaagaggaccgccgtaacgttgtccggcgcgcctctggacagagtgatgtggagcaggcgctggcagcagtccgacggctccccgccgtggatggcctcgtagagcagctcctggtccgtgacgatgttgctcagcccgtcggagcagagcagcaggaagtcccccggctggagctccttctcgtacagatctgcccggatgcgctcctcagagcccagtgcccgggtgatcaggttcttccggggatgagtacgggcctcctcgggggtgatgtccccccgcgccaccatgtcctccaccaccgagtggtcccgggtcaggcgggtgatcccgtcttcattgatgtgataggcccggctgtctccgatgttgagcagataagcggtctgctccaccaccaaggccgccaccatagtggtgcccatgccgcggcagtccgggtcggtgacggcccggtgatagactgccgtattggcggtctccgccgcccgcgaaagaacggcggctggcccggcctcgccatcgccgtccggctgcatgccctgcagggcgtccacgaaggtttccacggcgatgagactggcgatattgcccgccttggccccgcccatcccgtcgcacacgacgccgaccgccaggtgctctgaaggaacgtctaagtagaaaccgtcctgattttgtgttcttaccgcgcctttgtcggtaataccccatgcgtgtatcatactgaacttgcctctttcccgcgcgagtctgcctctgttcacgccctgcgcggccaggcgtgagccgacttatgttaagtgtgttcctgctgcattgtcttgcggcggagctgaccgcaggaggcgtcaatatcgccccccagcttgcggcgtaccgtagcggtgatgccgtggctctccagccgcttctggaaggccgccacccgcctgctgggcttgagggggctctcctccacattgttgaggggaatcaggttcacatgccccggcgtccccttcaggtgccgagccagcagatctgcctgccagtcggcgtcgttaactccgtcaatcatggcgtattcataggagatccgtcggccggtcttttcaaaataccggcggcaggcggcgaacagcttctccacccctacgctccggttgaccggcatgatgcggctccgggtttcgtcgtcgggggcgtgcagggacacagacaacgttaattgtaactgatagtcggccaatttgtcaattttttcagtcaggccgcaggtggacagcgagatgtgccgcataccgatgttcaggccgtcggggctgttgaccagctccagaaagcggagcaccgtgtcgaagttgtccagcggctccccaatgcccatgagcacgatgttgctgaccggggctccggagtccatctgggtgaaaagcacctgatccagcatctcagcgggtgttaagtcccgcaccttgccccctagtgtggaggcgcagaaagcacagcccatgcggcatcccacctgagaggagatgcacacagtattcccatgatgatagcgcatcaaaaccgtttcaatacagtttccgtctcccagccgccacaggtacttgatggtgccgtccagggaggagacctgcctgcgctccacctggggcgcgtagaggatacaggaggcggccagcttctcccgcagaggcttggagaggttggtcatctcgtcaaaagagaatacgccccggtgaagccactggaacacctgcttggctcggaacgccggctcccccagctccttgaaataggcggccatctcggtcagattcatggatttgatgtcggtcatgcgttctctcccccgccgggcctccccggcggctccagtccgtatttttttgccaccgctgccagacgctccggtgggatgggcgctggctcctcctgccgcaaaaaccaggaatcgtaatccggggcagggcactccctcagagggaaatcagcccggaactgatccgactgcacccaaacctgaaggaaataccaaccgcgctgataatctgtaaagggatcccgggtaatcatacgctgaaagccgggttctttcagcagtttagggtgataaggttcctcccgccacagctccagtcccagcaccggaaagttgtaagtatccgccaggtcgtgatccacacagtcgcacacaaagccggactcctttgacaggacggcaatcacatcctcctcatgggtgtggatcagatcctgaccacggtacaaaatccggatattctccgacgtattcagtccgatccgggacaagcagccttcttcatactccaggtaaaaggagtcagggggcttaggcaggcccagccggttccggagtttctccgcctcctcctgtgtcatgcccaagcggaaaggccccagcccaacacggggatacacctcataatccatcttaaatcctcctgagcttggcaaagaaaaagccgtcggtgccgtggcggtggggccagcaggtgagcatgccggtgtctgtatccaagaaggggccagaaacttggaatccctctagtgtaaagtctctctgcttgtccaaaaacgctctcacgaccccctcattctcccgctccagcagggtgcaggtggcgtagagaagcacgccgcccgggcgcacataatccgccacattgtccagaatggcggcctgcacacggggcaggttctccagaggctcaggatccttgtagcgaatgtccggcttcttgcggatgatacccaagccggagcagggtacatcggcgattatcagatcaaagctgttaagtaattcggcttttcgctccttgccgtccaacaggtttgcatggatgatatccaggcccagccgctgatagcccgcctcgatcaggcgcagcttgtgggggtgaatatcacaggaggtgacgctcccccggttctccatggcgatagcggcggcgaaggatttgcctccaggggctgcacaggcgtccagcaccctccaccccggctgcggcgcggcggccagcaccgccagatgggcggcggcatcctggatgtaaaagtaccccttctggaacgcctccaggtgttccagacttccggtgccgttcaggaacaggcagtccggcagccagggatggggttccactgccaccccctcggccgtcagcatggcagccagctcctctgcggagattttgagggtgtttacctgggcacaggtggggggctcgccgttgtcggcggccagcagggcctccgcctcctctctgcccagccgggcaacgaaggaatccaccagccactgaggatggctgtaccgggtggagaggtcggcgggcggctccagcgcctcccgctggcggatcaggctgcggagcaccccgttgaccagccctgcggccctgggatttttggccttctttcgggccaaggacaccgcctcgctgacggcggcgtgatccggcacccggttcagatacaaaagctgataggctcccaggcgcagcaggttgcggatagacgcctccagcttgtgcagcgggggggcacacagctttgaaaggtaaaaatccagcagcatccggttttggagtacaccgaagcacagccgggtcgccagagcggcatcccggccgtccagcttcgctccgccgatggcctttttcagatatccgtctgaccacgcgccctgcctctcgcaggcagtaagggcgtccagtgccacttctcgggcctgcttcatctaatccctccgtcgtcctgcaaaggccagcaggaaccgcagcagttgagccagggagaccagcagggctgccacataagtcatggcggcagcccccagcaccttgcgggcaccccgaagctcatcgtcctccagcagatgggtgccctccaggctggcaatggcccggcgggaggcgttgaactccaccggcagcgttacaagctggaacaccaccgccgtggcaaacagcagcacgcccacgccgaacaggggcttggagtagagcagcaggccgatgacgatcaaaatcagggagagctgggagccgatattgcagatgggcaccagggcggaacgcagcttaatggggccataccccaccgcgtactgcaccgcatggcccgcctcgtgggcggccactcccaccgacgcaatgctgttggagccgtacaccgcgtcggacaggcggatgacattgctccggggatcgtagtggtcggtcagccggccggagacccgctcaatgcgcacattttgaatgccgtgggcccgcaatactgcttccgccgcctgggcgccggtaaagccccggcggctggccatacgggagtaacggttgaaggtggaggacacattgagctgggccagcagggcgatcagcatggccggtaccaggatcatccagtaataggggtcataatagtagaaaaacggcatggaatccctccgttcacataatctgcccgcccaacaggtagcaccacaggttcgccaggaacccgacccccatcccgcccgccagcagggcggtgagccgggaccgtttttccgtcagccctgcggcgaacaggaagaacggcagggcgcaggacaggtagcgcccggcgctgagcagccaggacagggagtagttgagcaccagataggcgaaggcatagagcgtatacatgctccgaaaccgcccgcgggcgtaccagagcagtgggaaaaaggcggcaaaaagcagcagggtgggaatccagatctgaatccgtatcgcctcgtcatagtaggacagggcattttgcagcacataccacagagtgtctgagatccagcataagccctggctccagtgctcctgcatcaccgtaaaggcaaagggagcccccgccacggcggcgttgaggccgagataggccaggctgcccacagcgggcagtagtaccgccggcaggcggcggaggatggccctctcgtcaaatttccccagactctctaccaattccgctcccgccgccccaatgagtaacagaccatgcatgcgggtcatagcggccaaaacaccccacatacccgcccgccaccaacggtggcggcggatgtgccagagagcggcggccgtagtcagcaggaatagcccctcggtcatcaccccgccgaagaaaaaggcatatggaaagagagacaaaaagagaaccgtccgccgggcggcacctttccccagctcccaggccgccagccggtacagatagacgcaccccgcggaatagcacaaaaaggacaccatcaagcccgccgccatggtattatgccccgtcaaggggcaaaccagccgcaccagccagggatagagggggaaaaagaccagaaacaggggtctgccgtcctcccaatagccggtgtagcccagttcggccaggccaacgtagtgccatgcatcccatttcttccagatatccgtggcccaggacagaccggtacccgggtagagcaccaggcaggccagcgcggccaccgccagaaagacggtcaggcggaagagcagggcggcggagaacacatgcagaagctcccggcggcttacctcacagcctctggaggcagatgccggtacggcacagggcgccggaagtccggcggcccccagccaccggagcaacagagacagccccagggccagcactactccagagaccgccagcgtccagagcagatggatcatcccacagggatggggtgcccccgcagatagtcggcggccttcatgcgcttgccgccgtcggcctgaagctcgtcaatgcgtagcaccgtgccgccgccgcaggccacctgaattccctccttcccggcggccagaatggtgccgggggcggcggaagtcgtggcgcccagtacggaagcggaaaatactttacagcgattgccgcccagttcagtgacagcggcgggccaggggaccagccccctaacctggttatgcagcgcccgcgccgggcggctccagtccatgggggagagctcccggctcagcatgggggccagggtggccttgccgtgctcctggggggtgcgtgtggctgttccggcggcaatgtccgccaccacgttcaccagcagctccgctcccagcaccgccaggcggtcatgaagagctaccacagtctcgtcgggatcaatgggggtggcggcctgggcgatgatgtcgccggcatccagatcgtgggccatgtgcatgatggtcacgccggtctcgcgatccccgttgagcaccgcccagtggatgggggccgccccccggtagttgggcagcagggacgagtggacgttgatgcacccctttgggggtgcggccaggatctcatccggcagaatgcggccgtaggcggccaccacgatcagctcgggagccagctcctgaatcagcgccagagccgcgccgtcccgcagcttgacgggctgatagactgggatgctgtgggccaaagcgcacaccttgaccggcggtgcctggagcttcatgccacggttcctgggcttgtcgggctgggtgaataccccgcagaccgtgtgcccggcggcaatgagcgcttccagggagggtacagcaaaatcgggggtgcccataaacagaattctcattctccctgctcctccatcatgcggtccagctcctcagtggtgtagagccggtcggcatgctcggtgaacaggtggccgtccagatgctcaatctcgtggcagaagcagcgggccacgatctcctccccctcggcctcaaagaaattgccgttgcggtcctgggcgcgcacccgtaccttgtaggggcgcttgaccacgccccagcggccgggcaccgacaggcagccctcaaagccctcctgctccccctcctgggtgagaatctcggggttgaccagctccagcatgttgtcctcggcgtccaccacaatgaccacccggcggagaatccccacctggggggcggccaggccagccccgttggcatccgccagggtctccttcagatcgtccagcagcgtgtgcaggcgggcgtcaaagctggttaccgggcggcacatcttgtgcagggcagggtctccatccgtcaaaatcttgcgcagggccatggtgtttcctccttaatccagtgggttcacgtccgccgagacggacacccccttgttttccttgtcggtttgcgcacagcggaccagatgggccaccatagcgcgaatctcctttgtattttgtgccgccagagtcaggcggtagcggtagcggtcgttgatcttggccacgctggccggggcgggaccaaggacggtcagctcccagtcccgaaacggcggctgggccagccacccctccagggagcgccgcaggcgcatacaggtgcgcagcaccgcgctctccagcggccccgaggccgtcaggacaaacagctcccgaaagggcgggcacaggcgcatccggcgcagctcgatctcctgctcatagaagctgtcgtagtcctgacgggcggcgcagcggatcacgtcattctccggggtaaaggtctggatgaccgccctcccctgtttggccccccgcccggcccggcccaccacctgggtgagcagggaaaaggtgcgctcccccgcccggtagtcatccacatacagggagaggtcggcggagatcacccccaccagggtgacattctcaaaatccagccccttggccaccatctgggtgcccaccagcacgggaatccgctccttctcaaatcgggagagcagcttctcgtggctctgggtggcggagacggtgtcggtgtccatccgcaggatctcccgccccggaaaggcggcgtggagctcctcctccaccttctgggtgccgtagccgaggaagttcagcgccccgccgcaggaggggcaggcgtcgggcagcggctcggagtggccgcagtagtgacacatgagccgtccgttggccgagtggtaggtcaggtggacggagcagcggggacaggtgggcacctcgccgcactcgccgcaggtgaccatgcggctggccccccggcggttgaggaagagaatactctgctcccccgcctccatggcggcggccagcccggccctgaggggcccgctgagtgaggtgccgttgccggcgcggagctcctttttcatgtcggcgataagcacctctggcagggcctgctcgttgtaccggcggcgcagggtgaataggcggtagtccccccgcttggcgtggtacatgctctccaccgacggggtggcggagcccagtaccagcagggcgtcattctgagcacagcggtattttgccacgtcgcgggcgtggtatttcgggacgttctccgatttgtaggtggactcctgctcctcgtccagaatcagcagccccagattccgcaggggggcgaacacggcggagcgggtaccgatgaccacccgggcctgaccgctcctcacccgcttccactcgtcgtaccgctcccccgcccgcagggatgagtggagcacggcgatgtcgtccccgaagtgggaggcgaagatgcgcaggagctggggggtcagggcgatctcgggcaccagcaccatggcggtacggccccgggccagggcctcatagatcaaccggaggtacacctgggtcttgccgctgcccgtcaccccgtacagcagggcggcggcgggccttccggccgccgccagggcgtccagtccctcaaaggccgcctgctgctcggcgttgagcaccgggggagcggcccgctcccccgcctccaccgtcacccggcggaacacctcacggtgttccaggcgcaggataccgctcttttccaaagagcgcagggtggcgttggcggccccggtgaagtaacacagctccttggccgaggcgctgccgatggcgcacagcagctcggtcacggcgtaccgcaggggcgcggagcggcgccttggcgtgaccagggccatggcctcctcgggtgggatggccagcgaggccaccagctctttcttgtcccccaccccccgggaggcgctggtctccaaggtgagaatgcccttgtcccgcagcagcttgagggcgggattgggatcttttgtcccgaacgcctccttgatttgggccacatccgcctcccgccccgagacgaagagcagctccacgatgtgccgggcgtgctctgaccggcccgccgccgcataggccgcctcccgttccacgccgggggccagcttccagcggtcctgaagggagaagtacagccccgccgggagcatggcccgggccgcgtcgtacacggtgcagaaccagcgttcccgcatccacagggccagccggagggcctcgccgtccagcaccggctcttcgtccagaacggtgagaatgctcttgcgccttgggtcgtccgggtacccgccctccagcgccaggacgatgccctccgtccggcggttgcccgccccgaaggggacgaccacccgcataccggggcgcagggtgtccagcagctccagcggtacctggtagtcatagggcttgtcgatggcgtaggtagcggcctgcaacgcgatcttggccacggtattcccctccatctctccgccccccttcctccagaaaaggcaagcgccgggcgcttccccgtcgcttgccttatgctcactcctcgtcgttcagctcaaccttgccctcggccacctcacggatagcgatggtcacgggcttgtcgtccagcggaatcccggcatcctccgcctcgctggccacctggcgggcccgctgggccactacgttcaccagcatatagcggctgggtacctgcttgagcagttggttcatcgggggttcgagcatcatattggatcagactccttccacaagattgattcggtgcttggtacggcagctctccgccgtcaggatggcgatgatctcgcccgcggcctcggataccttgtcgttgaccaccagatagtcataattggggatctgcttgcactcctcacgggccttctggaggcggccctggatgaccttctccgcgtcggtggcccggcggtgcaggcggcgggagagctcctcaaaggagggggggatgataaagataaaaaccgcgtctgggcacttggcccgcaccttggccgcgccctgcacctcaatatccagcagcacgtcggtgccggcggacagcttctcctcgatcaggcgcagcgaggtgccgtagtaattatggacatattcggcgtattccaacagctcaccgccggaaatcatggactcaaactgctcccggctgacaaaattgtagttgacgccatcctcctctcccacccgcggctggcgggtggtgaaagaaacggagaagtagatgttttcccgttcgctcaggagctcagagatcaccgtgctcttgcccacaccagacgggccggagagcacaatgagctgccccctggttttctttttcaggttcatgcgtcctcatcctcctctggggcgggctcgttctcccggccgcccagccgcccggccactgtctctggctgtagggccgagagaacgatgtggtcgctgtccatgatgagcaccgcccgggtgcgccgcccataggtggcatcaatgagcacaccccggtcccgggcctcctggaccatgcgcttgatgggggccgactccgggctgacaatggcgatgagccgtccggcggaaaccatgtttccaaatccgatattgataagcttcatcctgcctcaccgccttactcgatgttctggatctgttcccggatcttctcgatctcggccttgatatccaccacgtatccggcggtctcaatatcattgcatttggagccgatggtgttggcctcccggttgaactcctggatcagaaagtccagcttgcggcctacggggccctcctgggccagcatgtggtccagttgggacaggtgactgcgcaggcggacggtctcctcgtccacagccaccttgtcggcatagacggcggcctcggtgaggatgcggctctcatcaagctgggtgttctgaagcacctccgccattttggcgctcaggcgggcccggtagtcggccacaataccgggggcgcgctcctccaccctggtagtgagggcctcgatggtgcgtgcccggccggtcacatcctggaagagcttttcgccctcccgcgcccgcatggcgtcaaagtcctgaagggccagctccagcacggagcagatgtccgcgctcacggcctccagatcctcctgggtcttctccaccaggaagacatcctggaaccgggagagcagggaaaccgaaatgtcgtcctttaagccgtagctgtcccgcaacgcgcacagcgcggcatagtagccatccgcaacaggcttgttgaccgagatggatacatccccgttctccgacgggccgatggtgacgaacacatccaccttgccccgggagatatgggcctgtaccttggatttgatggcgtcctccgcaaacacatagatgcggggcagcttgatggtgcagtccagatagcggttattgacggagcgcagctccacagtgatggagcggccatggaccacggcctctcccctgccgtagcccgtcatacttttcaccaacgcgggttccccctgttccattcgtcttttgttctgaggctattcaaaaattataccagactaggaagtctttcgcaataccctgtccacccgggccacataaaaggagatgagcttggagaagcccacgtcgtaaatcacaaaggctgcgttccccgccgcatagaccatccaaggcgcttgcagcgtctccggcaggaagggcagaaacaggctgtgcagaccgaaccagaacagggtcagaacggcgttgaataccgccagcttgcacagccactccagcggccggacgggaatgcgctccagcaggctcttgagcatgggccagaggccgaaaaagagcaggtagagcagggcgttggccttgtcgggcaccagcagcaggcccagcaggcctgctgcgccgtagcagaagaaccccgccttcagcccggccgacaccaccgcccccgcaggaaagaggccggcaatggctacaatacccatccgcgccgtgggcgagacggcggagagatagagggcgatcagcgacagcgcggccagcacgcccaccaaggccacccggcctgcgcccgtttcagtatggtttcgcatggctcagttcccacagcacatgttcatgcacaggcaggccgtacagcagtcgcaggcgtcgatcccaccgccgtagccgtaggggcggtaggcctgtccaccctggcgcatcatcatcagcgcctgccggtactccccgttggccgggtccatgttgcaggccatctggaaatgctgggtggcctcgtccagccagcccttgcggtaggcgatggacccggttaggaagtgccactcggcatcctggctggcagcgccgcggaggagctgctcggcccggccgatgtcgcccatgttgatggcctgccgtacctggttgtagaggctccctgaggaggcgctggagtactgctgctgatagccgccctggtaggagccgcggtaggccccctggctctggtagccgccggaggcccctcccccgctgcgcatcttggtaatggtatcgtaggcctcgttgatctccttcatcttctcctcggccagatcggccagggggttgttttgatagttgtccgggtggtatttccgggccagctcccggtaggcgcgtttgatctcctcgtcgctggcgtcgggcttgacccccagcacaatgtacggatctgtcatgaaatccttctcctgttttgatgattgacggccttccaacggccggtaaagaccagctcctccaccataggcagccccagatagaggatattctccacggcgccctgccagtggcccagctccaggagcgcacaggcggagcgggccaggttcagagagtggagaagggtggtgcgcagataatcccggttggcctccacctgctccggaaaacgggcggcaatggggttgtaggacccggtgcgtccgtcctcctccagatcgtcccaggcgtccaccaggtaaatccaccgccccacatggtagaggagctgctccagggcgcgggtccgggcggaggactccgccggaagggcggccgccgccaggatgcgggcaaaggtgtccgccgtccggtccagtgagggagagccctcctgctccagggcctggagctcctccagacaactgcgcaccgcccggtcaaactccggccgggcctgggccgcccggcggtagccgggtcggagcagaaaggacagaacccgggcggcagttcccttccagaagggaccgtccgccaccgtgtcccgcagcttccaatagctgaggatggttccggcgtccgccgccgcatccacgcttccggcgcagatgcagccctttttccgacaccagaggcgggccggacagtgcttccgctccgccgtaggcttcgagccgtccaagagcatggcgagaaaggtaaagtcgtagttcagaaagaaccgggcgaaaaagccgtgccgccttcccaatgcgtggcagagtccacagtagagggcctcgtagtcccgcagctcccgcactttcaactcgtcccggttggggcgcacatagccgaacatcaggcctccggcgcaatggcggtaatgcagaaggaaatggcctgctgcctgcgcacccggcggtcccacagaacggccagcaggagtcctagtgcgaacccggccaccccgacggccgcactgactcccgaagagagccggaaagccgcacagaggaaatagccggcgaaaaagagcaggaagggcaccagatagacgatcacagccgcgcccagtacccggctggtggaggactccaccgtcaccatgtcgccgggcatggcccggaccggattggcggctatcactgctacggtggagctgaccatcagttcgctgcagcctccgccgcatttggagcagtcgtggccgcaggcagactgacgcttgacggccacctccgccctgccgtcagccaggacgcgggttacctttgctgtttgaaccatactttcacctgatttctacgatcttgagaccgaaatggaaatgttgtactcaccgaccacgcccacctcgctgctgccatccagatagaccttgaccggcactgtccggcttccggtggacagatccaggttggacagatcggccacaatccggacttgggaagccgtgaccgcatctacggcttcctgggtgccgcggatcaaaactgtgcaggactgggtgttgcgtgtgatctcatagccgcccggcttattgacaatctcaatatttccagcctccagtgtcttagtgaccaagccctccacggtgacggttaccttggcctctgtaatgccgctgacattggtcagggatgggtccaaattgatcgtcatagactgtgtcagggtgccaaataccttggacaggtcaatctcacccaggctgatgcggtccagctgatccaggatctctgcgctgcccgctaccatcaaggttctgggctcaatgtctacggttacattatctgcggtggcaccgccgccgggaatgagatccacggtcagctccacctccttcatcttctccaccgggagggtgaccagcacggtctccggttccgtctccaccaggccggcggcgatgggctggccgttggtgccgatgagggtatagctacagtcggcgctgtaggtggaattcatgtcctcctgagagatggtgatttgggcgtgatccacctgactgaccagctcctcctggccgctgacggtaatggtatccggcgcgaaggagaagtcacggcgttggaagccttcggccacgctgccgttaaaggtgccttgaaccgggatctccttgctgctccagcgggaaacggtgaagtcgatggtacttgggctggtgtagcgtacatcaatggagtcgattatggtgatggagcggggaaaattgatgttgcgtgaggtaatagccacactctgctcccctggctcggtaataccggagacatccaccaccacagtggtatctccctggttcaggcggctccacacctcgccgcgggcagacagctgcaaattgaccgtctgctctgctccctcagagatcatcagtccccgctcttcaagcttttccaatccactgaataccacccggacattccgcagggttccggtgtccaccgagttggggtcgttgccgacgtagacccagaggagaaacgccagcaggatggagagcaccacatagaaccaccggctgttaagaattttcgttcccatcctgctttttcccctttccaaagcggagcagattgcccagcttgaatttggacgcggcctcgtcattctcccgttccggaagcagctcattgcggagcaggcgctccagagtctccggcgccaggtggcgcttgagcatgccgcccaccgccacggagatggagccggtctcctccgagacaatagccaccacggcgtccgtgtgctcacttgctccgatgcctgcccggtggcgcatgcccagctcccgcgacagatttacattgcccgacatgggaagcatacagcccgcgcccacaatccgtccagcgcggacaatcaccgcgccgtcgtggagcggggccttgttccagaagatatttttcagcagttcggcattcaccgtacagtccagcgcggttccggtcttaatggcgtcatctagcatgtttttccgctcaaacaccatcagcgcgccggtcttgctcttggaaagggacatataggcatccaccgtctgagtgatggcactatccagctcgttgcgtgcctcctccggtgtaaacaccttcccgaggctggtgcggcccatctgctccagaaagcggcggatttcaggctggaaaatgaccaccagggctaccacaccccacaccatgagctgctgaagcagatagctgaccgtgttgaggtggaaaaaggtggagacacccagggcaaacagcagcagcagtacgcccttggccaccgcgccggagttggtgcggcgcatcagcataatcaccttatagataagaaaggccatgatcgcgatatcaaccacatcagagataccaaacaggacgacctttcccttgaattcctggagcaaatacaaaatgccttccatttcctcgtctcccgcttccggccgcgccggcatccttgcttcccgcagagtacatgtatatcctttaactgatttattatactgtattcacaggcggttgacaagtagaagggaaatcaattttctgtgaacaggccctgtgtgcagacacaaaaaatagccgcagacgcggctatttttgcccggcggtcagccgcgcaacctcctgtgtgaagcgctcgacttcctggggtgtattgaaggcggagacgctggcgcggactgtcccagcctccagcgtcccggccgactgatgggccagcggcgcgcagtgcaggccggcacggacggcaatccctctggcgcccagggcctcgcctaccgcttcacagtccattccgtctatctggaaggagagcacgccggcctggacggctcccccatccccgtagacagtcacgccgggaatgcgggacagtccggcagccgcttggcggatcaggcggcgctcatgggtcaaaatacgctccgtcccctgtgtctgaacataacgaagtccctccagcaggccggcaatgccgggcatgttgtgggtgcctgcctccaggcggtcgggcaggaaatcgggcatggcctggagcgccgaggcgcttccggtgccgcccatgagtagtgggtgggtctccgccccgcagagcagcaggccggtgccctggggaccgtaaagtcccttgtgtcccggcatggcgacaaaggctgcgcccagctcccccatgtggacgggcagacacccggccgactgggaggcgtccagcacaaagggaattccacgttcccggcacagggccgcgatgccctccaccggcaggatgaagccgaacacgttggacacatggttacaaatgacggccctcaccgtctcgtccagctggcgctcaaaggcacggacttgagcctccggatcaaagagcgggcctgcagccacccggatattgacaccaagggcgtggagcggtcgggtgacggcgttgtgctcatagccggagatcaccacggcgtccccgggcttcaacagggaatgaatggcgagattcagcccatgggtggcgttggaggtgaacaccacctgttctgggctctccacctgaaagagctccgccgctgcctgacggcagagaaaggcggtttctgccgcccgcatggcgggaacatgcccgccgcggccaggggttgccaggcgccccactgcggacgaaaccgcccgcgccacggcgggcggtttttgtaaggttgtggccgcgctgtcaagatagatcatagcagaacctctttatagctgccgtcgctggacatgatatagatgcgcttgggcgtcagcccgacgcggcccaaaatcagcagcgccggggccagattgcgttccgaaaccttgacggagtggctacacccctccccggaaatcatctttggcgagcggaggatgtgggccgtaatgcccgcccgctccagagcggaggccgtccgctgggcgtaggtcagggaacggcagacaatgagatagtaaaccatatagaaacgctcctctcagtgcagtgtatgcaccggaggagcgtctggttcgccggttacagaaggttctccaccaggcagacggcatgggcggcaatgccgtctcccgtgccggtaaagccaaggccctcctctgtggtggccttgacgctgacagcgtccaccggcacctggagccgccaggccagattccggcgcatttgctccagatagggggccagttttggggcctgggccagcacggtggcatccacattgcctacccggtatcccctctgacggaggcgggaaaccacctcgtccagcagccgcaggctgtccgcccccgcgtaggccgggtcgctgtccgggaacaggtgcccgatatctccaagggcgcaggcgcccagcagggcgtccatcaccgcgtgggtgagcacatccgcgtcggagtgacccagcaggcccttgtcaaagggcacctccacaccgcccagaatcagccgccggccctccaccaggcggtgtacgtcatatccatgtccaattctcactgctgctccctccaagcgaaaagcgcctccgccaccgccagatcctccggggtggtgattttcaaattgcagtagtccccctgcgtcagggatacgccgatgcccagccgctccaccgctccgcagtcgtcagtcagggcggccccgtcctccagggccttgaccagggcggccttgatcagatccacctgaaacacctggggtgtctgcacggcaaagagctccgaacgctccagcgtagcctccaccagactgtcccgcgctcgctttatggtgtccttcaccggcaccgccggggcggctgcgccgcactctgcggcgcggaaaatcaccgtctccagcacctcctggctgaccagggggcgggccccgtcgtggatggccaccaactccgcgccggaggggagctccccaagcccggccagaaccgagtgggtgcgggtagccccacccactatcaccttgcggaccttggacaagccggcatcccggcagagctggccaatggggacgatcagatcctcccgggtgaccacgataatctcggcgagataggggcacagctccagcgcccgcagggtatgtagcaaaacgggctgctcctccaggggaaggagcagcttgtcctggccctccatccgggtggagctcccggccgcggggaccacggcggaacagcggagctccggtgtccgctgccgccggaacagccgcccaagcagtccggccatgtccattcctcctccacaaaaaaagagccgtttcggctcctcccccgtttccctccaggggtccggtgggcggtcacagcggaccgcccctacagactgtattaggccaaggcggtatttatgcgcgcctcaacatcttcataactggcatcctgcgagagcacaatctctgagatcaaaatctgcttggccgagtggagcatcttccgctccccggtggacaggccgcgctcctcctcgcggagcatcaggcccttgactacacgggccacctccagcagattcccgctcttgaggcgaagcatattctcccggtagcgccggttccagtttggggtcatgtccacctcgatgtccgggatggccgcgatcacccggtccgcctcgtcgcccttcaccaccgggcgaacaccgatctcctcactgtttgccgtggggatcatgaccagcatgccgcccaccggcagcttgagaatgtagtaatcccttaccacgccgttgacttttttctgcacgatgctgtcaatgataccggcaccgtgcattggatgcacaatcttgtctccaacctgaaacacgctcccacctcccagcagaacattccgatgcgtataacttcatttttaccctacatatcgtattatagacgcattcctcaccctttgcaagtcattttgtgtgtcttatttgtaaaaatgaaaaaaaccgtgcggtttccaagcggaaacagcacggtttcattgtaggaatgtgattactcctcgttgacatcctcggactcagcgggctcgtcgccgccctccagcagggcgcggatggacagggagaccttcttattgtcgtagtcgatgtcgatgatcttcacatccaccatttggccctcgctcagcacgtcaccgggcttgtcgatgcggtggtcggcgatctgggagatgtggatcaggccgtccacaccgggcacaacctcggcaaaggcgccgaaggtcatcagcttgactacgcggacattggccacgtcgccgggctgatacttgccggtgaacacctcccaggggttctgggagcggtccttcatccccagggagatcttcttcttctccttgtcgaaggagatgacatagacctccacggtgtcacccacggagacgacctcggagggatgcttgatgcgggaccaggacagctcagagatgtgaaccataccgtccacgccgccgatgtccacaaaagcgccgtaagaggtcaggctcttcacagtgccggtatagcgcttgttctcctcaatgttggcccacacctcggcggccttggcggcgcgctcctcggcctcaacggcgcggatggagcccaccacacggcggcgggcgcggttgacctcggtgatgcgcaggcggacatgctgcttgagcagctggctcatcggggtctcccggggcaggccagtctgggaggcgggcacaaagacgcgcacacccttgatggacacaacgacgccgcccttgttctcctcggtgaccacaccctcaacggtggtgtgctcctcacgggcctgctcgatgtcatcccagctcttcacggtgtcaaggcgcttcttggagagggtgaccacaccctcctggtcgttcacacgcatgacataggtctcaatctcgtcgccgatctttaccagatcctcaaccttggccgtagggtcgtcggtcagttcggacaccggtatgtaaccggcgtgcttggtgccgagatccacatagatctcagtaggcgtaatgccagtgacaacgcccgtaaccttctcccctgtatttaaagttttgatcgacttctccagcatttcagcgaaggattcctcgatctcaatgttttcgtcgctcattttgtcatagacctcctttataatccactcaggcgtggacgcgcccgcagtgattccaatagaagccttccgacacaggttggaaggttccagctccgccgcccgttcgatccaaacgaccatgggacagagtgccccgcataactcggccagccgtttggtattggagctctcccgccctccgatgacgaccatagcatcggagcgcgcggccagcgcctgggcctcagactgtcgtttacacgtagcattacatattgtatcaaaaatttttaagtttgtacactctttttttgctttttctacgcaggaatcccaaataaaacgggtggaggtggtttgtgagaccatagtgagaggtatgtcccgccgttccggcgcggtttccagccagttcgacagctccgccaccccttccagcaccaccggccgccggcaccatccggcgatggcggccacctccggatgggtgcgggtgccgatgatgagcacctgccgccccccctcctcagcgcgggagacgatctggtgtatgcgggacacattggggcaggtggcgtcgatgaccggccggcccaggcgcgccagcgcctcatggacgggccgtccctccccgtgggaacggataagcaccgccacccccggcggaacctcctccggggtgtccaccaggcccacccctatggactccagataggcgatcacgtcccggttgtggatgatgggccccagcatgacgcatggccggccctcctccgccgccatctccgccatctgcaccgcccggcggactccgtagcagaagccggcggagcgggccagctccagcctcaccggccagcctgaggcttcaaagcctcaatgcgctccatcagatcatcggccaccgcgtggtagtcctccggcgtgggcttacgcccctcgggggccttaggatagtatgcctcgccgaacacgacgggattccagcggaaccactttttctccgcaggaagatagatggggacgatgggcacgccggtacgcagggccagcatggccgcgccggtcttggcatcgccgaattcgccgtcctggtggcgggtgccctccgggaacatgagcagcagttcaccgtccttcaggtacttcatcgccgtcttgatagccgccacgtccgccttgccccgcttgacgccgaaaatgccgccgtgcttcagcacccagccgatgaagggccagtgcataatctcctccttggccatgacgtggatctggtaatgccaccccagtgcataggcgatgaacagtgggtcattggtgcgggtgtggttggcgcacagcagcgcgcccccttcgggcctgttctgtttattgatgcaccgtgtgggcatcacgatacggaacacgacccagagtaccatataggcaatgcagtaaatgacatttttctttcgcttcttcatgccttcagacgctcctttatggtttccagaaggacgtccaggctctcgtccagggaatttccggtggtatccaccagcagggcgtccttcgcctgccgcagcggcgcggcggagcgccgggtgtcgtgctcatcccggagaatgatatcccggagcacggtgtcatagtccgcctcctgcccccgcttccgcagctcgtcaaagcggcggcgggcccggtcctctggcgaggcggtgaggaaaatctttacatccgcgccggggaggaccaccgtgccgatgtcccggccgtccatgatcacatcgtgctcccgggccatgtcccgctgacgctccaggagaaaggcccgcaccgccgggatggccgacacgccggaggtataccgggagatcacatgctggcggatggcatcggtcacatcctcgccgtccagatacatatgctgcaggccgtccgcgccatacttcagctcgatgtccaggccgtccagcagagcggtcaccgccgcctcgtcctccgggtccactccggcccggtaggcccgcagacctacggtccgatagatggccccggtatccacatacaaaaagcccagcctgcgggccagcagcttcgccagggtggactttcccgccccggaggggccgtccacggcgatgctcttgtgctttgtcatgggttgattcctcctatgtcttgtgcggcggcctctccagcggcgtggccggtggaccaggcaatttgcagattgaagccgccagtgtaggcatccacatccagcacctccccggcaaaatagacgccgggggccttcttggattccaaagtggtgggattgatctcggatacctttatcccgcctgaggtgacgatggcctcctccaccgggcggggcccctgtatgtcgatgcgcaggcacttgaggacctccagcagacggcggcgctgggccttcgtcaccgaatgaaccttctccgccgccgggatgccggtacgctccaccagcaccggcaccatcaggcggggtgccaggccctccagaacattgtgaaagtcccggttggcgttctcctcaaagtcccgcagcagacggcggtccagcttctcctcatccagtgcgggcttcaaatccagattgatgtagtagtgctctgtgtcaaagtcccgcatatgggcgctggcgctgagaatcagcggcccggacaggccaaagtgggtgaacagcaactccccctgcccggcgtagacggtcttctttttgctgttgcgcacctgaatggccacgttgcgcagcgacaggccctgcatttttgcacaggcatccccctccgccaccagtggcacaaggctgcctctgggcggcagaatggtgtggcccagcgcctcagccagggcatatccgtcaccggtggagccggtcagcggataggaaaccccgccggtggcgatgaccaccgccccgccggggtaaaagccgcgctccccctccacgccggtgaggatctcaccctcccgtcgcagggcgcgggcccggtcctgcacaatgtgcaccccggaccgacgcagggccaacagcagggcgtcgatgatgtcagcggctttgtcggagcagggaaagacccggttcccccgctctgttttcagcggtactcccaggccctcaaaaaacgccttcaccgcctccgggggaaagcgggtgacggcgctggtgaggaaccggctgttgcgtgggacattctgcagcacctccggcgccgcacagtcgttggtcacgttgcagcggccctttccggtgatgtagagcttgcgccccagcttgggattgcgctccagcagggtgacggctgcacccttttgggcggcggcgacggcggccatacagccggccgcaccgccgccgatgacaattacatgcttcaagtgatctcttccactttctcatagacctcatattcatcccagatctgctccagtgtctcaaaggtctgggagaggtcgtcgtttttcttgcgaccgatggccacaatcagcgcgttgatcagcgacagcggagccaccagggagtccacgaaggacgccatatcgctcttggccagcagggtcagggtggagatgggagccaagggggaggtttcgctgtcggtgagggcgatggtggcggccccccggtcgtgggcaaactgcatggccttcaccgtccggcgggaataccgcgggaagctgacgcccacaatgacatcgttgggaccgatgcgcaagagctgctcgaatacctcactggtggaggtggcgtgtaccacggtgacattgtcaaaaatcaggttgaagtagaagcccagaaagctggccagggccgccgcggagcgcacgcccaggatatagatgtggcgggcgtccacaatagcgcttaccgcccggtcgaagtcctcccggttggtctcctccagagtcatatggatcttatccatatccgactgcatgaccatggacaggatgtcctgattgccgatgcggtcgttggagacctcaatgcgctggatggaggtgagcttgctccggatcatctcctgcagggccttctgcatagcgggataaccgtcataccccagttcagcggcaaagcgcaccacggtagactcactgacgttgaccgtcttgcccaggcggctggcagtcatgaaagcggccttgtcataggattccaggataaagccggcaatcagcttctgtcccttggaaaaggtactcatattggtctgaatgaccgaaaggatatctttggacattgtggacgatccctcgcatttctgcccgcccgtggcgggaatgataccacgctgtgttttgattcgtccctatcataccgggaattgaccggaaaagcaatcccctttctgcaagttttcctgatctccttgcaaaaaagagatcattttcgcaggagacaaagctcctcacctgtcaggcgccgccatgctcccacaggcagcgcgcccaggcagagctccccctcccgcacccgctggaggcggcgcacccgcaggcccgctgcggcgcacatccggcgcacctgccggttgcgcccctcatggatgaccacggagagcactccctcccccgccggagtgacccgggccggacggagggcgtacccatccagctccatagggccccgcagcaccgggagggcggcgtccacgtcgccctccacccacacccggtattccttctccacctcgtggctggggtggagaagggcgtgggtcagcgccccgtcgtcggtgaggaggagcagcccctcggagtccagatccagccgcccaaccggccacacccgggcgccgcagccggccaccagctccgccacggtgcgccgccccttttcatcagagagggtggttacgtagcccctgggcttgttgagcatcagataagtacggcgggcgggccgccgcagaggccgcccgtccactcggatgtcgtcccgctccgggtcggccttgtcccccacccgcgcggtacatccgtttaccctcacccgcccggcggagagatagccctccgccgcccgccgggaggacacgccgtgggccgaaaggattttctgcagccgctcttccatggccgctcccccctttttacaaattcgaatcagagatccagcggcagcagaccgtcgccagcgtgtcggcctcccccgcccggaaccagtccagcacccggccgaacaggccgcggccggcccggtcgtccgccacatcgccggcatagagcagataggtctcgccgattaccgcgccgtccagcgtaaagagcagccggccggcaatggttccgccctggatcggggcctccacccgctccggcagctccacacgggccctgaccagctctccttccgtcagcggatagtacacatcggcggccgtatagaccggaacaaagcggttgaggctgcccgtcaccgggagcatgcggaaggtccggttcgccagggccagcatggcgctgcggtagtgggcaaagccatagtcaaacagggcggcgtggtctgcccagtcgttgggatcattcagcgtgacggcgatcaggcgctgcccatcccgctccgcacaggaaaccagcgtccgccccgccctgtccgtgtagccggtcttgaggccagtgcagccctcataccgccagagcagcttgttgtgattggtgagggtgcgccctgccaccgtaatggaacgggtacccacgatctttgccagcgcttcgtgctccatcaccacccgggccagggcagccatgtcggcggcggtggagtggtgcccctcgtcattgagcccgtttgggttttcaaagtgggtgtgctccatgcccagctcggcggccttgtcattcatccaggccacaaaagtgtccacgtccccggcgcagaagcccgcaatggccaccgccgcgtcattgcccgaggcgagcagcagcccgtagagcagcgcctccagcgtcagctcctcccccgccttcagatacatggaggagccctccactccggtccactcgggccggatggtgactacctcggacagatcagggtgagattccaccgccaccagcgcggtcatcagcttggtaatgctggcaatggggcgctcctcctccgcgttctgggcataaaggacccggccgctttccccatcgatcaggatggcggaggcagccgagatgccgggcccggcggcccggacggagggacagagcagaacagccagtgtcaaaaggacggcggcaaaccgtttcaaacagcatcacctcaggggatagatgctgctagtatgcgtgtcagccctgggatttatccttgtcctgctgcttctcgataaagccagtgaccttgtcaatcacatcgggcaccatctctaccacccggtctacggcggtgccgggcggaggcgctacgggcatcaggcgcaccgagtcccccttgacaatcaggaaggccaccggggacaggttcattcccgcgccgctgccgccgccgaaggagttgtcgtcctccggcttctggttcttggaggtaaagtcgctgccgccggaggcgaagcccaccgtcagcttggagatgggaatgatggtgatctcaccggccaaaatgggcttgcccacaatggtgttgacgtccgcgatctcccggagcttctgcatagtggtggtcatcagatcaccgatgggatgttgcttttccatacgttaaaccgcctctttctgcttgcttgtcgccgggctcccggcctcggcgcgatacttggagaactctgccagaaaccgtgtggtcaggcgcaggcccagagccagcgcctggccggcggtcagggtggccgccgcgtagagataaacggagggctgctccgcgtcaaagtccacccgggtgcgcagcctccgctccttcacgttaaaattctgctccaccagcggccagatcataccgataaatgcgttcaccccgccgaagcacagggcggcggcagcggggtccggcgccgccgcggtaacttcaagctggaacacatcaatgcgcagcttgcgccggaagcgccccgccgcctcggcgatcagcggaagaaaccgcttcaccagcgccagcggcccgccgcccagctccggctgcgggcgttcctcccgttttttctcccttcgggacgatttcccagcctttcggcggggccgtttcggctttctgggatagagcatcaggcgcagcggccctaccttcagtttgagccgcagtccggcggcggagtactccgccagcgcgcccagtcgcaccaggcggaggagcgctcccagcgccagaagcaccgcgcccaggatcaggattgctttcatccagccctacgcctcctcctcggcctgtgccatctcccgggccgcctgaagcagctcctcctcggtgacctcctctgtcccctccgcggtctgggcggcctgaagccgctccaccgccgcctgcatctccagggtaagctgtccgtcctccggggtggtgttgggcagctcgggcagctcatccagattggatagtccgaaggagcgcaggaaggtctgggtggtgcggtactggatggggcggcccggcacggccaagcggccgcactcctcgatcaagtcacgctccagaagcaggctgacggtgtaggagctgtccacgccgcggatctggtccacataggcccgtgtggcaggctggtagtaggcgatgatggccagcacctccagggcgggctggctcaggcgggcgggccgccgactctcaaacgcccggcggatgcagtcggcaaactccggcgcagagcagagctgatagctgttgtccagccgcaccaggcggatgccacgccgctcatagcggtaggcatcggccaggcgttggcacacggagtccgccgtgatccggtcgatgtccagcgccaaacacaggcgctccacccccaccggctccccggcggcaaagaggaccccctcaatggcggattcaatttccttcaattccatagtataccctcaatctgccgttttctccccatcggtggtcagctccagctctcccccgccctcctcggtacaggtcacggtgcagtcgctctccgtgcctgccagccgcaggcggcgggccttgcacagctccagcactgcgataaaggtggccaccacctccgagcggctccggttgcccttgaacagagcccggaaccgggtcacaccgaagcggctgagccgttccagaatttcgccggccttgtccgccaccgggtagggctcccggcccacgatgccctcgaaggccgccatgggtggcgggaggcggtggtccacccgggccagcaccgccgtcatggcacgcagcagatcctccggcttgtggacgtagcggtaggtcctattaaccggcagggcctcgggcaccttgggaatatagtcccggccgatggcgtagcggtcggacagctctggcacgatggccttgatcttggcaaagttttcgtggcgctggtgctcctccagagaggcaatgagctgttccatctcggagatggcctcctcgtcgtggatggagagcagcatccgcgtcttgatgaacaccaggtgggccgccatggtgacaaactcgctcgccacctccagatccagccgcttgcgctgatccatccactccagatactggtctaggatcagggagatctggatgtccttgatctccatcctgttcttgctcagcaggtggaggatcagatccagtgggccgttgaagtcctccatagcctcatcccgggccttgaccaccttttccagatgaaaaatcggcgtttcgatggcgcctcacctcaaaacagatttaaaatagcagacgcgtcctggaacagcagcaacccgcccagaggcattccggtgagggtgcaaaagccccgtaggacatggaccatcaggaaggacaggggcttgtcgaacacccccaccagcaccaggaggatcaccactcccatcacatacttctcatagcgcaagatggtgtagtagattcggtcgggcagcagggcgaacaggattttggagccgtccaggggcgacagggggatcaggttgaacagccccatccccacccccaacagggccatgttggacaggaagcacagcacgaacaccgccgccgggcccagaggggccagatggaacacggcggagctgactcccaccgccgccagggcggtgaggaagttggccgccggtccggctagggcggtaagcgccattccctgcctggggtgcttaaaatagcgcatatccaccggcaccggcttggcccagcccaccttggccacaagcatcatcagcagacccaccacatccagatgccggatgggattgagggtcagccgcccggcatttttggccgtgggatctcccagtcgccaagccacaaagccgtgggacagctcgtgcagggtgatgcacagcagagctgccgcggcactgataaggagggtgagcaggccccaccagtccatgttgttgagaaagtcggatatggagcccaagcgtccgcccccctagcacaaagatcgtgtcaattatagcaaatttccaggagaaactcaaggaaaagcggcggagccctcccctgagcgtccgccgtcctctcatacaatggtgttgcataggattccgatgcctgaaacctccacctctactgtatcgcctggttgcatggggcccacaccggcgggggtgccggtggcgatcacgtcccccggctccagggtcatggaggcggtgatgaaagagatgagcgcccgcacaccagtgatgagctgctctgtcctcccctgctgcaccacctgaccgttcagtcgggtggtgatggtcaggtgttccgggtccacctcgtcggtgacgacaggccccatgggggcaaagccatccatatttttgccgcgggcccactggccgtccgccttctggacatcccgggcggtgatatcgttgaggcaggtgtagcccagcacatagtccagcgcctcctcctccggcacatccttggcacgccgcttcattaccacggccagctctccctcgtaatccagccgccctacaaagtctggggcgtgaaccgtccccaggtgggcgttgagggcgttgggggccttgagaaacagggtgggccggtcgggggtgttggaggcatccaacatggacttcatttcatggatgtggtcgaaatagttctttccaatgcagacaatttttgtggcctcacagggagccaggaggcggcagccggacaggggcaggctctctccgtcataacggacaccctcaaagggcggctctgtcagagtgcgcaccacatcgccgtggagcaccccccacacgccccttccttctcgcagcagtttgacaaatctcatacgcttccctccgcgtgctccaggatcagattgagcagctcctgtttgccgtctcccttctcggctgaaaagggaatcagctttacaggctcgtccagctcaagagtttcccggatgcgcgccaggttcggctctatgtcgctcttgcgcagcttatccagcttgttggccacaaccgcaaagggacggccgctgttcttgaaaaactccgccatggtgcagtcgtccgccgtgggcttgtgccgggcatccacgatcatcagtcccagggtcatcagggagttgtccgcgaaccactcctccatcaggcgaccccagcgggctttctccgcctgggacaccttggcgtagccatagccggggagatccaccaggtagaaagcgccgtcgatcaaaaagtagttgatgtgggtggtcttgcccggtgccgcgcccacccgggcaaaattcttccggttgagcagccggttgatcaccgaggacttgcccacgttggagcggccggcaaaggccacctgaggcaggcgatcccggggaaagtccccggccttggccgcggagcgcacaaactccgccttctgtaaattcacactcatgtcaattcctcactgtcggaaggtgggtacttcccggctccgggagccggactcagggggcgggagcgcgtcatcccgaagggggtcgcaggtcttcagctccagcgcctcggccagcaccgaatccacctgctccaccggaacaaagtgcagagcggcccggacggtggggtcgatctcctccagatccggcacattgtccgccggcaggaacacggttttgatgccgttgcggtaggcggccatggtcttctccttcaggccgccaatgtgcagcactctgccccgtaaagtaacttcacctgtcattgcgatctcccgcctcaccggcgcgccggtgagggcggacaccatggcggtggtgatggcaatgccggcggaggggccgtccttgggcactgctccctccgggaagtggacgtgaatgtccttcgtcttgtaaaaatccgcctcgattcccagttggacggcgcggctgcggatgtaggacagggcggcctgggcggactccttcatgacgctgcccaggttgccggtgagctctaccttgccggagccgggcaccacgcccgcctccacctccaggatctcgccccccacctgggtccaggccaggccgttgaccacgcctacctgctccgtccggggcagccgctccgggtgatagcggcggatacccagatagtcctccaggttatctcctgtgatgtgaatcgactttacaccatttgacacaatgtccatagccgccttccggcacagtgcccccagcttccgctccagaacacggacgccggcctcacgggtatagccccgaatcagctcccggatggcgtcgtcggtcagcctgagctgggcctttgtcaacccgtggcgtttcagctccttgggcagcaggtgccgcttggcgatctgcagcttctcctcatcggtatagctggtcagttcaatgacctccatccggtccagcaggggccgggggatggtatccagggtgttggcggtggtgataaagagcacgtcggagagatcgaagggcacctccagaaaatggtcgcggaaggtgctgttctgctcggcgtccagcacctccagcagggccgaggcgggatcgccccgctgatcattgcccagcttgtcgatctcatccagcaacagcagcggattacagctctcagcctgcttgacggcggcaatgatgcggcccggcatggcccccacataggtcttgcggtggccgcggatctccgcctcgtcatggacgccgcccagggagatacgggccagcttacggtttaaggcccgcgccatgctcatggcgatggaggtcttgcccacgccgggaggccccaccaggcagaggatctgtcccttcagtccgggggccagttgcttgaccgccaggaactccagaatgcgctccttgaccttctccaggccgtagtggtcgacatccagcaccctgcgggccgcctccacgttgacccgctccttggtgtgcttgccccagggcagctccagcacggtatccaggtaattgcgcagaacggtggcctcggcggagccgaagggctgcttctccagccggcccacctctttcgtgagcttgtccgccacctcctggggcagcttggccttggcgatgcgctggcggtactcggcaatctcgctgtcgccgccggcaccctcctcccccagctcctgctggagaaccttgagctgctcccgcagaacatagtcccgctggctgcgggtgagctgctcccgcaccttgccctgcatctcctgttccagctccagaatctccacctcccggcggaggctctggcacaggcgctccaggcggcgcaccggccgcagctcctccagaatggcctgcttgtcccccgtgcgcatgggcaggttctgggcgatgtagtcggcgatgtagcccgggtcctcactggagagcaccgagaggagcacatcgggagtcatcttgggggccagctcaataaaccgctcgaagagctcgtaggtctggcggataagggcctccgtccgggcggagcggcggaccggctgttccgccggaagctcctccaccagggcgttcaggtagggcgtggtcttgggcagaaggcacagccgcccgcggctgaccccctccaccatcacccgcacgttgtctccgggcaggcgcagaatctggcgcacattgcagatggtcccgatgctgtaaaggtctttttcctgcgggctttcaacggccagctcccgctgggccaccaggaaaatcggctggcctgaggccatggactcgtccagtgcctgaatggacgcctgccgtcccacatcgaagtggagcagcatctgcggaaagacggtcagcccccgcagggccagagcaggcatagtttgctgccggttcagttcttccatcacacattcacttccttccagggcagggatttgatgcagaatggggcgagggatgctcccccgccccaccggttcagttgctgtttaagagacatttcccttgggggatacgcccccctgctccgcatggagggcggcaccgccaagacggggccgctgggtgcggtcgggatcgtgctcaacggcgggggaaacgtgttctttcacgctctcagccgtaatcgtcacccgggtgatcgttggatcagagggcacctcgtacatcagaggggtcattacctcctccagcacggcccgcaggccgcgggcgccgatgccgcgctcgatggcccggtcggcggcagcctccagcgcctgggtatcgaagtccagctccaccatgtcgtactccaacagcttctggtactgcttcaccagggcattcttcggctcggtgaggatgcgcaccagttgtcccttgtccagagcgttcagggtggtgatcaccggcaggcggcctaccagctccgggatgattccgaacttgagcaggtcatggggctgtacctgcttgagcaccgaggcagtatcccgctccttcttactctggatgtccgcgccgaagccaatggtctttttgttcaggcgctgctcgatgatcttctccatcccgtcgaaagcgccgccgcagatgaagaggatattcttggtgttgatctggatgaactcctggtggggatgcttgcggccgccctggggcggaacgttggccacagtaccctccaggattttcagcagggcctgctgcacgccctcgccggacacgtcgcgggtaatggaggtgttctcactcttgcgggcgatcttgtcgatctcgtccacgtagatgatgccgcgctcagccagctcgatgtcgtagtcggcagcctgcaccagtcgcaggaggatgttctccacgtcgtcgcccacatatccggcctcggtgagggtagtggcgtcggcgatggcgaagggcaccttcagaatccgggccagggtctgggcgaacagggtcttgccacagcccgtaggccccatgagcaggatgttgctcttctggagctccacgtcctccccgccgccgaagtagatgcgcttatagtggttgtagaccgccacggacagggcgattttagcgtcctcctgcccgatgatatactggtccagcacgtcgcggatctccctgggggtggggatcacatcggggatgtccggcccggcctgctcctcgggatcgtaagtgtcgtccagaatgctcatgcacaggtggacacactcgttgcagatataggcgcccggaccggcgatgatgcgggcgacctgttcctggtgcttgccgcagaaggaacagcgcacggatttgcgctcgtcatttttcggcatggtttgctccctcaagtctttctaaggctcagagggagcggggcgtttgcttccccgctccctctgttggattttatcgcgtataaatgaccttgtcaatcaggccgtactccttagcctcctccgcggacatgaaattgtcgcgctcacagtcggctgtaaccacttccagcggcttaccggtgttgtccgccagaatgtggttcatgcgctttttgataatctccaggcgcttcaggtggatggccatatcggtgatctgtccctgagtgccggcggagggctgatggatcatgatctccgcgttgggcagagccaagcgcttgcccttggcgccggaggagagcagaaacgcgcccatgctggcagccatgccgatgcaaatagtggatacatcgcacttaatatactgcatcgtgtcataaatggccataccgtcggtgacggagccgccgggactgttgatgtaaaactggatgtccttgtccgggtcctgggcctccagatacagcagctgggccaccaccaggctggccgtggtggcgttgacctcttctcccaggaacacaatgcggtcgttcagcaggcgggaaaagatgtcataggaacgctcgccgcggttggtctgctctactacataaggaactaggctcataatgaaggatctcctttaattttgatgtcggggtgcagggcgccccaccatcctaccgcagacgggcaggctcacaaacagagtatgcccatcgtttggaaacttattcctccgtcttctccacggccgcctcggcggtctcctccaccttcttgcgggaggtgcccttgcgggcggtcttcttgggcttctcctcgccctcggcgctctcctccgccttcttcttggtggacttcttcttggcgggggccttgccgaccttggcgctgtcgtagaccacgtgctcagccttgtggtagctctgctccttgcggatactgtcggcggtcactgcggccttcaccttgtccacatccatgtgatactgctcggccagacgtttgtactcctcctccagctcctcgtcggagatggtgatattttcggcagccacgatggcgcccagcgccagctcacggcgcacgcgctccagagcagcggccttggcctgctcccgcatgatatccatggtcatgccggtcatggccagatactggtcaaaggggataccctgggcctggatgcgctgggccatgtcgttcaccaggttatcggcctcatactccaccatggcgtcgggaatctcgacctccatgttgtccataacctgctccatcagagcggcctcgaagtcacgctggttctgagtctcgcggcgttccttcagcttctcacccagatcctttttaaagtcggcgagggtatcgaactcggacacatccttagcgaactcgtcgtccacctcaggcagctccttggccttgacctcgtgaaccttcaccttgaagacaacagccttaccggccaattcggcgtgatagtcctcggggaaggtgatgttcagctccttctcgtcgccggctttggcacccacgagctgctcctcgaagccggggacgaaggaaccggagcccagctccaggctgtggccctcggccttgccgccgtcgaagggcttgccgtccaggaagccctcgaagtcaatcaccacagtgtcgccggtctcggccgcccgctccacggtcaccatgcgggtggcgcggttgatgaagggcttgagctcgttgtcgacgtcctcatcagagatggcgacctcggccttctcagcagtcaggcccttgtactcgcccagcttcacctcggggcggacggtgaccagggccttgaaggtcaggccctccttgcccacatccacgatctccaccttgggccacgccacggcatccagcttctcctgctcaatcgcctgggcataggcctcggggtacaagtcgttgatagcatcctcataaaacacgccggagccgtacatgccctcgatgatcttccggggggccttgcccttgcggaaaccgggcacgctgatcttgccgcgctgcttcttgtagaccttctcgacagcggcctcgaactcctccttgccgatctcgatcaccagctcgacggtgctcttctcctgcttctcgacgctcttgacattcatgttgtttacttcctcctgtcagccctgtcccgccgcgcatcggcggtatacggggccatctttcgcgttatccgttatatactagcagatatgcgtcaaaatttccataccttttttcaattattcacagattttttgcgggcgaaaccccacatagtctgcggagaccagataataggccacgcctccctgccgtccttccacggccaagcggtggctgccgccgtggagatggccgtaatagcagcgctccacgccgtactgctccagcagggcaatgatctctggacagcggtagccttggtagaggggcggatagtggagaaagcacagcttgggccgctcccccgccgccttcagcgacgcctccaagcggatcagctcccgcttgaacaccttctggtcgccggtctcctcatagaaccagccccgggtgccgcacagggcgtagcccccgtattcatagcagttgttgtgcagaatgcggagggttgaaaagccgctctccgcaaaaaagcggttcatcttggcggcggtgttccaccagtagtcgtggtttcccttgagcagcagcttccgcgccccaggcagggcgtccaggaaagcgaagtccttctttgcctcctccagactcatgccccaggacaggtcgccgcagagcaccaccgtatcctccggccccaccgccgcgaagcccttctgcagcttgtccacatagccctcccagcccccgccgaacacgtccatgggcttattggaggacagggagaggtgggtatccccgatcgcgtagagagccattcagcgcagcatctccagcacctggtccaccatgtgctctttggtgacgctccggccaaagcggaccgtcttgtccttcagggcagccaagggcgccgggacgggtacgccggtctgctgggagagctggtccaaaatggccgtgccggcggccagctcgctcacgcccagggcgcccagcacgctgtcacagaacttgaaggggctggcggtggacaccaccacggtgggggtagtgtcaccagtatcccgccggtactggtcgagcacgtcaaaggccacggcggtgtggggatcgatcaggtagcggtgctcctgccacatgcggccgatgaccttctgtgtctgagcgtcgtcgcagaaaccggcggcgaagagcttctccagcctgcccttgatggcggggctcacctcataccgcccggaccgggccagctcctccatgtacccgcgcgcctcggcgtcgtcgtggttagacagggagaagagcagccgctccaggttggaggagatcaggatatccatggagggggacatcgtattgtagaaggtgcggttgcggtcgtacacgccggtgcacaggaagtcggtcagtacattgttgctgttggaggcgcagatgagcctgccgatgggcacgcccatctccctggcgtagtaggcggccagaatgttgccgaagttgccggttgggacgcagacgttgatccgctcccccttctgaatccgcccctcccgcagaaggtcacagtaggcggagatgtagtagacgatctgcggcaggacgcggccccagttgatagagttggccgaggagaggaaaaagccgcggccggccagcttctcccgcagggcctcgtcggagaacaggcgcttgacaccggtctgggcatcgtcgaagttgcctgccacagagcaaacccctacgttgtccccctcctgggtgttcatctgcagctcctgaatagcggaaacaccgtccttggggtagaacaccaagatgcgggtcttgtccacgtccttgaagccctccagggcggccttgcccgtgtcaccggaggtggcgaccaggatgcacaccgtcttctcctcttggtttttcaccagggaggcggagagcaggtgtggcagcatctgcagggccatgtccttgaaggcacaggtggggccgtgccacagctccagacagtaggtgttttcgtccaccgcccgaacaggtgccacctccttcacatcgaacttctctccgccgtaggccttgtccgcataggcagacagctcagagaccgtgaaatcatccagataggagttcatcacatagacggcccgctgctggtaggacatgtctcgcatggtgtccaaggcgttgtgggacagctttggaaatacctcgggggtcataaggccgccatccgcagccagtccctgggcgattgcctccgccgccgtgcgccggtcttccttgttcctcgtgcttacatagtacatacttcgctcacaaccctcatcagattctcaaaaaacagggcgcgcaccagcgcctcactgtaattccgctgcagcagccgctcccacagccggtccagatcctgaatacccgtgatcccctccggcaggctggaacagccgtccagatcgccgcccaaagcgacggtccgctcgccccccagctccagccagtgctccaggtgggcgatggcggtgtccaggtcggcccgctcccccaggaagttggcgtagaggttaaggccaaccactccgttgtggtctattatggcagtaaattgctcatcggtcaagttcctgggatgagaaaagaccgcccgggcattggaatggctggcaaaaaaggggccactcagctcctccgccacgtcccagaagcctggatccgacaggtgggacacgtccaccagcatgcccagccgctccattttgcggacgaacaccctgccctgaggcgtcagcccccgctccggctcctctgcattcgtgccggagagggcgttgacgtggttccatgtggggttaacggcccgaacccccatggcgtgggcctcctccagccgctccagggagcagtccagcagctccgccccctccaccgagaggaaggccgcccgccgccccgaccgaaaggccgcctccgcctccgcgccagtgcggcaaaaggctgctagatcggcattggccgccatttcccgctcaaagagcgcgtactcctccagaaagagctcccggtgggttttcccgctgagatcccgaaccggggtgggctccggctctccgaacagggcgaaaaactgggcgcagcggcggtatttccccatacgctccagatccacatggccgtcgttccggcgcaggcctccgccggagagatagcgcagaaacaccgcgtcacagtgtccgtcaaacaaatcaattgcataccgctccatctggaactccccctaaaatgcattttcaagccaggtgatccgggggcggcgggtggcggtgccctggggggcgtagatctccgccacgtcaaagcggggctggcgcgcctcctccgggtgcttcgccagatagagctccgccgtggcgcgcaggcgggcctgcttccggcgatccaccgcctcccgtccgagggcaaagcgctcctccgtccgaagctttacttctataaaggataaatacttgtcagtagctgctatgaggtcaatttccccaaaccggctgcggtatccggccgccaggaccttccagccctttcgcctcagttccgccgccgccagcgcctccccccagcggcccagcagctttgcctctcccccgctcacagcttcttcaaaaaggtccgccggtggatgggacaggggccgtaccggcgcagcagctcatagtgccgcttggtgccgtagcccttgtggcgctcgaactcatattccgggtagcgttccgccatctgctccatatagcggtcccggctcaccttggccaggatagaggctgcggcgatcgaagccgaaaggctgtctccctttacaaccgtctggtgctccaggaggatagccgccgttttgccgtggtcccggttgccgtcgatcagcgcaaagccgggtgcgggctccaggcggtcgatggccatctgcatggacttgatgcgggcgctgaggatatcggtggcgtcaatctcctcggcctctacccgggccaccgcccaggccaccgccacggttcggatcgtgtcgtacagggcatcccgccgcttgggcgtcacctgcttggagtcgttgagtccctcaatggagcactcggggggcagaatgaccgccccagcgtagaccgcgccggccagcgggcccgcccccgcctcgtcacagccgcacaccagggcgatccccctcgcccagcaggcacgctccagcgcccagcggtcaatccctgccatgggccgcctcccggctctccagatcttggggcgtctcaaatgtcaagtttcccagcttgccggagcggtactcgtccagaagcaccttcgccatgcgctcggtgtccacctcgccgccagagatccggaagccccgctttttgccgcagagctccagcagctcccagccaggcagccctgggtcagcctccagcttataccgctcggccagcgcctgggggtagcgccgggccagcagctcaatgaggtgacaggccagggtctccagatccatgatttcgtcctttacagcgccagtaaaggccagatggatgccggtagtctcgtcctcaaacttgggccagaggatgcctggggtatccaaaagctccagcccggcatccacacttacccactgtttgccccgggtgacgcccggccggttgcccgccttggcggacttccgcttggccacctggttgatgaaggtggactttcccacgttggggacccccaccaccatggcccgcacagggcggcccaccagccccttggccttccactgctccagcttctccttcagcgcctgccggatgacggtggagaactggccaactcccttgccgtctctggcgttggtctccagcaccgcccagccctgtctgcggaaccagtcagtccatacccggttcatggccggatcggcctgatccgcccggttgagtacgatcaggcggggtttctcccccaccagttcgtcaatatcagggttacggctggagatagggatgcgggcgtctatgatctccgccaccagatccaccagtttgagatccgcctggatctgccgcctggttttggtcatatggccaggataccactgaatattcacgcgttcaccctctctaccgaatattcttgtattatacacaatgctccggtatttgaaaagggcaaagacgcataaaaagtgcccggccaatggccggacactttttagcggctttggatcgtactatttgagccagccgatggagacgcagttactgggtgcataccaggtcacgttgcggcccaggccctcaaagagggcgcgcacggcgacatactctacgccgtccacagtcttgacgggcagcttaaccgacttgccatccagcgtaaccagaacgctggagccttctgtgcgcttttctgcactgataccgttcacaatgtcgttcagaggaacccagattttcccgggctccacaactagcttgttgttgaaggactgaaccaggccattccacatcactgtgggaacagaggcatccttgcggtagacctcctcacctccggagacggtaagcagcacttgggtgtccttgatgtactctgcggggcaggtcatcagatcacggtcaatcactgcaaagtccgccagcttgccgacctccagggaacccttgatatcctcattgaactctgcataggcagaccagttggtaaaggaacgcagggcctcctcacgggtcatggcctcttcaatatgccagccgccctttggctcacccaggcggttggtgcgggtcacggctgcatagataccgtggtaggggtttaccagctcgaccggagcatcggagccgttgggaatcacactgcccttgtccaaaatggtacgccaggcataggcccccttgatgcgctcactacccacgcgatcctccgccaccagcatgtcagaggtagcgtgtgtggtctgcatagagggcagaattcccaggctgatggcgcggtcaatgtcagcgggcgccacaatctggaagtgctcaatgcgcagacggtggtcatcccggggattggccttgatggctgcctcataggcgttgatcatctggttgttggcgccgtcaccgatgcagtgggtcgcaatctgataaccggcgtcataggccaccttaacgacttcgttcacctgttcctgtgtatagcggtaatcgccgatatggccctcacggtcggagtagggttccagcatggcggcagaacgggcacccaaagacccatccgcaaacatttttacgcagcgcagactgagatgattgttgtataaaggctcgtaattctcattgtcaatgggatggctcttcaaatactcggcggtctctcctgcggcagatgtgtgggaaatcatcccgtagacgcgcagcttcaactctccggactcatacaggggtacaaagacctcgttatatacctcaatgctgttgcctgcatccatcgcagaggtcagcccataagagaatagctgctcttgcgccttcagcaggccttcctgcatctgctccaccgtcagctctggaatcagctcccggatgggattcatggcggtatcggtcatacagcccagcagctctccatttgcattcttcaggtactcgccgccctggggatttggcgtatcgggggtaatcccagccaactcgatggccttgctgttggcccagcccatatgcccgcatgcccgggtcaggaatactgggttgtttggggcaaccgcgtccaactcctcctttgtagggtagctggtgtcctcccatactgtgttcatccagccgcggccctggatccattcccctggctttgcctgttcggcggccgccttgactagatccaaaatcgcctgcttgggcatccagaagcagtccagattcatcagactgctgcccaagccagccacgtgcatatgtccctccaccaagcctggaatgaccgtctctccacccaaatcgacaaccttggtatcgggaccgatgtaagcctccacaccggcctcaccgcctacatagaccaggcggtcgcctttgatcgccagcgcggtggccttggaaaatgcctcatccacagtatagatgtttccgttgcggtatacgctgtcggcagcctctgtaccggctgccattgcagggaatgctgagagaagtgtagcgaggactaagcatgcggcgagagctttacaaatgcgtctgcgtgacattatggttcctccctcatcatattcttctttctgaattcctggatcagcgtgcggccccctaccctccttccagtcttcatgatcacagcgtatcacattttatacatcatatcaaggaaaaacgcaaattaaatttgttatttttcacatattatactccgcggtatagagatgtgagcctcagtattgcagaagaaatacttataaaaaggctgtggagaggcagttgcctctccacagcccaatatccaagactcagatgcgctccttgaccttagcgctcttgcccacgcggtcgcgcaggtaatagagcttcgcgcggcggaccttacccttgcggacggtctcgatcttctcaatggtgggagcgtggatggggaacaccttttccacaccgacgccataggagatgcggcgcacggtgatggtctcctcgatgccgccgtgcttcttggcgatgacggtgccttcgaagacctggatacgctcgcggtttccttccttgatatggacgtgaacgcggacggtgtcgcccacttccgccacagggggctcggctttcaggtacttgttgttaaacgcctgcatgagatccattttaaaacttcctcctagtttataggtgttcttgcagccatggatgccgcctacctttggcggcggccgcagaggaccaccctttattgagactgcaatagtttaccacaagtctcaacggattgcaagcagaattttcatcccatccgtgtccctcggcatggtttggctgcaggcggcaccagcagccaaagcgcggtaatgagcagagtgaggtttcccctcccctgccagagcagcagcagcgctccgagaaccagccccactgccagcgcggaggagagcacccgcagcagccgttctgcccgttcctccgaggtcagcagcgccaggatacaccagaggatgcgcccgccgtccagttggacagcgggcagcagattgaatgcggccagcgccagattgagcccagcaaagcagtacgccccctccgtcccaagcccggccgccatccgggcggccagcagattgaccgccggaccagccagcgcagcggctatctgctgccagtagcccagcggacagcgggcggagagacgcatctccgcgccgacacaggtgatgcgcagggcggttacccgcccgcccagggcccggatgaccagccagtggcccagctcgtgcagggcacaggcacaaaaggccatcagcagtacaccctgttcatccaaatagtagagcgccgcccccagcagcagcgcgcctgcgctgatttcaactcgtttccatctcagcattcagttcgtctcgatataatagagcgggttgagcagcactccgttcagcttcagctcaaagtgcagatggggccccgtggaattgccggtggcacccgagagggccaccctctctcccgccgccacggtctgcccctgctgaaccagcagctcgctgcaatgggcataaaagcttttcagccctccagggtggctgagctggaggtagagaccgtaaatcgggctgtcgccgatatagtctacggttccgtcggcaaaggccagaacatccgttccgtcgttcactgccagatccacgccgttgtgaaatttctcaccaccgtctaccgggtgttcccgccagccaaagtcggatgagacccaccccagcgccggagttaccgtctcccccacgcccaaggctttcagattgtagcggtccatggtggcgttgtccgggagcgtgggaccgttgtactctacatggactacggccggctccggcgtggcggtgggaaccggagtgggttccggtacggtattgggctccgctggttctacagcgaccggctccggcttcccagcctcccccaaccagtggctcaccgcatcctcacgtgcggggaagccgctgagaaatgcggcctgggcgcggaacaggggcgtgctcacctgtccctctccgtccggcaccgtgacagcctctccgccaaagacctccacccaaaggtcccccagggtgtccaaaatcggttccccctcggagatcgaccggcccaggctcgcaaacgcagctttgaaatccgtgtcggcctgaatagcgctcaaaacagtctcccgtacctccgcgagctttcctggaaatactccttttccgataaataccaccagaaacagcgccagacatactgccaactgcgccatccggcgcttctcacgcggacccagcgccacgctgcccttttttctccggtgggacagcgccggcctatgcccgcccgtccgctcctgcctccgcttttcccacttttgataggccgtttccatagcggcatcttcccttctgtacgcatttcacagcatgtatatgcggacgtgccttttgctatgcggagaagatttcctctcttgacaactggcggcaagacagctataatagtatccgtcgtgtgaacggggtgtggcgaagtttggtatcgcgcatggttcgggtccatgaggccccgggttcgaatcccggcactccgaccaagcgtagagaggcggacaggattttatcctgtccgcctctcttgtttcatatctgtctttctgtagcccccttcatatgctgatgaaccagtcatataattattgttgaaaataaaaatacaataatattgattttttaaccgcatgtcgacaaaaagtcagcatttggggccctgtttttggaagataacacgcccatttacgcaaaaatgtggtatattgaatataaagttatttctaataatgaattccattatgtcagttcgtttttccgccatgtcagtaccctattttcgacgattttccctaaaatagtagtcgtatactatctacgggaggtaaatctatgaatttcgacaaacagcttgacgtattttccagaaacctgtccgaaatccgccggaacggccgctactcctaccagtcattctctgaaaagcttcgggttgggaagtccacggttcaggccatcgaaagcggagactacaatattacgctgagtacgctcatcacaatcgctaattccctggaaatccatccggcactcctgttgatggatctgccgatagagttggatctaacagggacaaaccgctattatgccaacttacttatgacctactccgccctgccggaggaacagcggtcccagttccgaaacatgatccaacgcctggaatgcagcctcgatggggaccatttagagcagaacgacaccggagtgaactgaaatggaaattgcagcccgcctgcgccagcttggattcccaagcaactatgtggggtttccctaccttgcctgcgccatctcattggtgcagaccgagccggagtacctatatcaggtattcaaatgtctttatcccgccgttgccacagcgtttcaaacctcggcagcctgtgtggagcgggacatacgcaccctgctctgcgcatactggcgctccggcggccagccattattgcaggccatctctccgcgtccgcttaccgcccgtcccacggtcagtgagctgattgccctgctgtccgggtatttccaggatgtcggagacctataattcggggcgcatcatggcatactgaagctgaggtgatttccatgttgacagaagcggaattgctccagtatatctaccagactacagaaatgggccgggacggcattcagtccgtcctgccccacgcggaggacgagacctttcaccaggcgctggagcagcagctcacggagtatgaaaagctctacggcgccaccggaaagatgctgcgggaacgtggtcaggagcccaaggggctcaatcccatggtcaaggcatcctccgagatgatgagcgcgatgaaaaccatggctgaccactctacctccaagatcgcggagatgatgattcagggcaacaccatgggcatgaccaagagcctcaagcacctgcacgactaccatgggaaggacgaacgggtacgggatctggccaacaagctgctgaaaaccgaagaggccaatatccagcagatgaagaagtttctctagtctcctcaagggcggcgccgaattggcgccgccctttcttgcgcttgctgtcacaaaaaccggaacatatccgttataatgggtgaaaaccggttttctatccagcagacaaggaggaggatgctatggacgaggcggagctgagccgggcgttccccatcggggacggcgcctgtctggaggcagtcatcgcccgctatggacaggccctgctgcggtactgccatcatatcctgtgtgactaccatgaggcccaggacgcggtgcaggacgcgctgctgcgggcctggagtcggcggaacctcttccgggcgggtaccaatctggaggcgtggctctacaagctggcctatcacgcctgtatcgacctgctccggcagaggcggcggcaactctttgcccctcccccgccgtccggacacaacccagattacatcgggccggagctgcgggcggccctgtccgtcctcacgccggaggagcggggcctggtcttcggacgggtgatggagggccgctcctatgaggagctgtcccagatctacggcccgtccgccgccgccctgcgcaagcgatacgagcgggcgcggaagaagctggccctggcactgagcgaatcggaattggatgaacagaaggaggtcgttccatgaagcggacaccagaggaggagcgcattttccgcgccctcgctcagatcgaaaccccagaggccgacctgtccgccgcactccggcggacggaggagccgcgccgcatccggcccgtccgtcccctggcggcggcggctgtgctgtgcgccctgctgaccatcggcgcggcggcggtgggcttttccggggcgtggcggtactttgccccctccctgccccagaacgccgtgcagaccgtgggggccagccagacctccggggactacaccctcaccgtggaggaggcggtggtggacgacagcaattttatgctcctgctggccctgacccgggcggacggagagcctatcgatccagaggcatcgctgaccaccaacagcatggatctggaaataacggtggacggccactattttggccgcgccaccgactaccagctctcccctgacggaaaaaccatctacatctgctacgaaaacactggcgcactgaccgagacatccattttgggcaagcctatcaccctcacggccgatggagtggccgtaaggctttttgacgatgacggaaatattcgtatccagtgcgacacccctatctccctatctgcgcttgcggaatgggggactccggacttctctgccgtacccctggtggagcatgtagaggagattatccaaactgcggcaaatggtggggcaactcttccgttgtttacggtggagggagttcccctcctgacacttcgcggtgcggccctgacctcggagggactggccctggtgacgcaggatgcctcctacgtctccggtgatctggcgtatacgagaagcagctgtgaagccatcatcgatacccgcaccggagcacgctatctttgccgctccggtcacggagcagcattagaggatggcacctgggcctttctggaggtattcgatgactgcccctttaccctggaagatcttccctatcttgaagtggaggtgtcctataccgtcgaccggattctctctgaccagccgttttcgctcacttttacggtggaaaattcatccgggtggaaactcccgctggatagtgccctggaattagacgggctcaccctgcatcctttggaactgcggttgtcagccctggatctgcaagtctatttccaagatgaagcggaggcggccttctccctctatcgggacggtaccgctccggtgctccatctggcaaacggcacagatatcaccaccacctggcatggaggcagacatctggactctgctctgcctatggtgtctttccaaaccatagatgccgacagccagcggctgttcatcgaccccgcacaggtggtttccatcacctttggaaatctggagatccccgtggagcactgacctgtttccctccccaaaaacggcgcgcccggtttagggcgcgccgttttccattgcccggccccggcaaatctgctatgattgtaagagatttgtcagaattgtctcacgctctttgacagaaagggctggtaagatagcgtccataggagggatttgtgtgaacgagtgtattctggtggtggatgacgatcccgaaatcgtccgtgccatcgccatcctgctggaaaaagagggctatcaggtgctcaaggcctacaatggcatggaggcgctggagcaggcgataaaccccgccctgcggctgatcatcatcgacgtaatgatgccaaggctggacgggctttcggcggtgatgaaaatccgggaaaagcgcaacctgcccattattgtgctcagcgccaagagcgaggactcggacaaggtgctcggcctgtccatgggggcggacgactacatcgccaagcccttccatccccaggagctggtggcccgggtgcgcagccagctccggcgctatacccaactgggtgacgtgaacgcccaaagccagggcggagagatcgtcaacggccgactgtgctaccgcccggaggagcgggtgctgctggtggacggggagccggtgaagctgacggccacggagctgaaaatcgtggatctgctcatgcgcaacctggggcgggtcttccccgccgaggagatctaccgacgggtatggaacgaggaggcctatgccacagagaacaccgtcatggtacacatacggcgcatccgcgaaaaaatcgagctcaatccaaaggaaccggaatatctgaaggtggtgtggggcattggatacaaaatcgagaagcgttaagcccgccctggcctttctggctttcgtgctgggcgtcacgctgctggtctacagtgcggcggcggctgtgattgtgaccgttgccagcgggggctctttctacatcccctggcgcgacatattctggaccgactaccagactacggacagctttcacagctttatagaagcccgcctctatgaactggcctccgccgccgataccccggaggaggaaaatcccctggagggctgggacgacggcctgctctaccgcgtccgggcggatggagtgctgaagttctccaacaccgacgccctgtctcccgaccggctgcccgacgggtataattttctgatcacctacgacggggagaaggtgactgccgtcaaggacggccgcgacatctccggtcagttctcccccctccccttcgcggatccggccggtgtgtccgtctctctggctgcggccgagcacccgcccgcatccggctcgtcgtctctcgcctccctggtcggttctctccggcagaaccgtgccttctttttctgcttcctgtttcttccgcccctggcgggtatcgccctcaccgccctgtccattgtgtggcaccgtcacaaggtgcgggccgaccgggccatcgcctggttcaccgggcgggtgtggctggaggtcaagctcctgctgctcgtccccttcctctgggtgtgcgccctggccggaatgtgctgtctggccgcgctgctgggacaggtgctcacctacagcattgtgcgctacctctccgtccccctggccctgtggtgggcttacctttatatcaacgacctgcggtacaatttcggacacctcaaggagcagagcctgtgcgccgcctgtgtgcgcctgctccggcggcagatcctgcgccaccccgccgcccagcgggccgaccggcggatgatctggcagtttgccgcctgcatcccctttttcctgttctgcgccctgtcggtgccggcctttctgctgttccgcctgtcccccctgctggttctcccgctctgcctggccggatgcgcgctgatcggtctccaggtgtggctggtcagggaaagccgccgctctgccgctgagctggacgccctgctggcctgcattgaggccgccggggcgggaaggctggagggagcccctcccctgccgccggactcagatttccacggtgcagcggagcagctctcccacatggaagcgggcctgcgcaccgccctggacgagcggatgcgcagcgagcggatgaaggtggagctgatcacaaacgtctcccacgatctcaaaacccccctcacctccatcatcagctataccgagttgctccagcaggaggagggcctgcccgaccatgtgcaggactacattcgtgtcctctccgacaagtccaagcggctccaggtcatggtgcgggacgtgttcgaggtgagcaaggccgctacgggcaacctgagcgtagatataaagccgattgattttgtaaagctgcttcgccagacccttgcggacatgggtgaggccatcgaggagagcggccttgccctgcggccccgtctgccggagtccccggtctggatcgccgccgacggcgaccggctgtaccgggtgttccagaacctgatcggcaacgccctcaagtactccctggagggctcccggatctacctggagctgaccgtagcagacgggcaggccgcggcggtgctccgcaacacatcgcgggaggagctgcccaacggggtggatctcaccgagcggttcgtccggggggacgagagccgcaccgacgggggcagcggcctgggcctgtccatcgcccgcaccttcaccgaggcctgcggcggaactttctccgtccaaacgcaggcggatctcttcaccgcctccgtctccttccccctgaccagggaacggccgcccaaggaggagagcgcggtatgagacggctatgcgcgtgctttgccgccctggcgccggccattcatgacttcctgcggattaccggccatcaataggactacagtaccgttttagaagccgaggatgcagcctccccctgtccgaaatgagtttatcaacgcagcatccggtataccatatataaaatccggcacctcccaaaatgggaggtgccggattttatttgacgaatctttgtgtttatactacaataagagtattatcaggcgatttgaaagcgaggaaaatggtatgccagacagcaattcaagccacaatcccctcggctccctccccatcaataccctgctgcccaaattcgcaatcccttccattgtcgcctatctggtcacctctctttataatatagtggatcagatcttcatcggccagggcgtgggatatttgggaaacgccgctaccaatgtggctttccccttcaccactgtgtccaccgccattgccctgatgatgggcatcggcactgctgccaacttcaacctgaatttaggggccggaaatgaggaacgggctcgccgggtggccggcaccggactgtcctgtcttgcgctgttcagcctcaccctgggcctgatcgccttgtttttccgaggcccactcctcaacctgtttggcgctacgccggaggtattgccctacgccatgatctacacaggcattaccgccttcggcctgcctatggtcacctttaccaccggggccagttccctggtccgagccgatggaagtcccacctattccatgctctgtaccctctccggcgcggtactcaacaccatattggacccggtgtttatcttcggtctggacatgggcgtggccgggggcgcgctggccaccgtattggggcaggctctctccctggtcatggtactgtactatctgttccgcacccgcatccgtaccatccgcctgacggcggcctccctgcacccttccgggccacttctgcgtgccatctgctccctgggtgtttccccctttttaaatcagatggccatgtttctggtgcagatcaccctcaacaataccctgacctactacggtgcgctctcccactacggtgaggacattcccctggcgtgtgttggggtcatctccaaggtcaacatcctgatgctgggctttaccttgggtatctctcagggctgccagcccatcttcagctacaactacggcgcccggcagtatagccgcgtacgtgaggcctaccgaaaggccattgtcgccgcgtccataatctgttgtattgcctttgtgtgctttcagctctttccccggccgatcgtggcactgttcgatccctctggcagcgaggagtattttcagtttgccgagcggtatttccgcatttatatgtttatgacactggccaatgccttccagcccattacggccaatttctttacctccattggcaaggccaagcggggcgcactgatcgccctcacccggcaggtgatctttctcattcccctgattttgatcttccccctcttcctggggattgatggcgtcatgtacgccggtcccatcgccgacagcgcggcagtagtggtggccctagccctggttacccgggaaatgaagcggatgccccacgtggacgaacccgtggcggcagatacgctggtgtagctggctccagcggcggcgggcaatgtgggcggcatcaccgccggctcttagacctctaggggcagccaatcggcccatcccgtactcttttctcgataccggcaccatagggaagtggccctgggcggccgttccggctgccggtatctgaggctgtcaccccggcttttccggctgctgcgtggatcatatgctgttccccgaataaccaaacaggaggcgccccacggggtgcctcctgtgtttactttcacagatacagctcgggcggcttgtcccccttggtcaatgcctcctccaaatgagccgctgtagcggcaaaggcggggccttccacccgtcggctgcccgccgggcaagcccggacacaggccaggcagcggatgcacttctcaccgtcggtcgcacggggcgcggcaggatggatggcctccaccggacaggccccgacagcttctccgccgcccggcgtcccagctccgcggccgccgccagatcccctgcgttgggtcgccccatggctaccttggcggaaaatgtgtgaggcgctacaaaggcccccgccgccagagggcggaacccccgggcggcacacaggtcgctcagctccgccagcgcgtcgtcaatgagccggttgccatacacagccagcagcaccgccggagtctcctccccctgtaggccgtccagcagccccggcacctccggcacccggccgtaataaaccggtacgcccaggacaactacgtcatctgcgccgaacatatgaactttgcgccgctcctccggccgggtcaggtccacttctccgcccatgtgtggcatagctgccgccacagctcggacataggtgcgcgtcccgcccgtgggactgaaatagagggctgttgtacatctatgcatgtgttccgcttcctttccacttgtttgatacacaggaacgtgccgtggggaaaaacaccccacggcacgtctgcctgtttgccgttcggctattgtactgccttctcagcagcagctgttcccgcagccgttgttgcagccacagccaccacagccgcaaccgccccagctcccgccgccgcagcagcaacagagcaggataatgatcagaatgatccacaggcagccgccgccgccaaagccacagccattattgcaccccatatgaagtacctcctggtttgatgatggaaaccagaggcggagcggtgggagtaccgccgctccggcccggtctcactccatactatgccggggacgcagaggggtgcttggtacaaattctttttattccagctcaaaggcgccggtatagagctgataatagagtccgtgctgccggatgagatcctcgtggtcgccccgctctacaatgcggccgtgatccagcaccataatggcatcagagttgcgcacagtggatagccggtgggcaatgacaaagacggtgcggccggtcatcagggagtccatacccctctggacgatggcctcagtgcgtgtgtcaatggaggaggtagcctcatccaggatcattaccgggggatcggccacagcggcccgggcaatggcgatgagctgccgctggccctgggacaggttggcgccgttgccggtgagcatggtgtcgtacccctggggcaggcggcggataaagtcgtctgcgttggccagcacggcggcggcctccacctcctcgtcggtggcgctcagattgccgtagcggatgttttcccgcacggtgccggtaaagaggttggtatcctgaagcacaatgcccagggagcggcgcagatccggcttatgaatatcgttgatagagatgccatcatagtggatcttgccgtccgcgatgtcgtagaagcggttgatcaggttggtaatggtggtcttacccgcgccggtggcgcccacgaaagccagcttctggccgggcttggcgaaaaggctgatgtcgtggaggatggttttgccctcctcataggcgaagtccacatcatcaaagcgcacgtcgcccgccagcttggtataggcgaagctcccgtcctcctggggaaccttccaggcccacagattggtgcgctcactggtttcctggagggcgccgtccttgttataggacacgttgaccagggtgaccgtgccgtgatcctcctcggagggctcatccatcaggtcaaaaatccgttgagcaccggccagagccatgaccacagagttgagctgctgagagatctggctgattgggttggtcaaactcttggagagctggaggaaggatgcgatgacacccagggtaataccgccccccaggccattgagggccagcgctccgcccaccatggcaatgaccacatattggatgttgccaatgttgatgaggatgggcatgaggatattggcgtacttgttggccttataagcgctttcaaacaaggcgtcattcacacggtcaaagccctcctgggcctcctcctcgtggcagaaaaccttgaccaccttctggccgttgatcatttcttcgatatagccgttcagatcgcctagcttcacctgctggcggacgaagtagcggccgctgcgtccggccaggaaccgggtcaccagcagcatgcacacgatgcacacgattaccacgccagtgagagtgaggttgagtacaaccatgctgacaaaggtgaccacgatcatcatcagggaattgattacctggggaatgctctgggagagcatttgccgcagggtatccacgtcgttggtgtagacgctcatcacatcgccgtgggcgtgggtgtcaaaataccggatgggcagggtctgcatgtgtccgaacagatcgtcgcggatcttcttctgcacgccctgggagatggtgaccatcaggcggttgtaggccagggcgcacagggcgcccaccacatagaggcaggccatcgtaagcagggcgtggagcaggccggtgaagaccggattgtccattgcaagcagaggcatgatatagacatcgatcagatccttgaggaagagagagctggccactgaggccaccgcgctgaccaggatgcataccagcaccagaaaaaagcggatcaggtagccccggcccacataactgagcaggcgccggaccgtgtgggactttttcttcggcatcttattcatcctcgctccctcccttcgtctgggattcataaatttcccggtagatctcacagctctggagcagctcgccgtgggtgcccatggcggaaatccttccgccatccatcaccaggattttgtccgcgtcctcgatggaagagatacgctgggcaatgataaacttggtggtgtcggggatctcctcccggaacgccttgcggatcagtgcgtcggttttggtgtccacggcggaggtggaatcatccaaaatcagaatcttcggcttcttcagcagggcccgggcgatacacaggcgctgcttttggccgccggacacattggagccgccctgctcaatataggtatcgtacttgtcggggaattcctggataaaggggtcagcctgggccagcttgcatacccggaccatctcctcatcggtggcgtccttcttaccccagcgcaggttctccttaatggtgccggagaacagcacgttcttctggagcaccatggccacctgctcccgcagggcgtccatgtcgtagtcccgcacatccacaccgcccaccaggatgcggccctcggtagcgtcgtacagccggggaataagctgcaccagagtggtcttggaggtgccggtgccgccgagaatacccaccgtctcaccggacttgatgttcaggttgacgtttttcaggcactccttactggggtccttggcgtagctgaagctgacgttctcaaagactacagagccgtccttgacctcctccaccggattctccccgttgcacaggtcgctctcctcgttgagcagctcggtaatacgctcggcggaggcgcgggccaggatgatcatgaccagcaccatagagagcatcatcaggctcatgaggatcatcatgatatagctgaacatactggtgagctgccccacatccatgctgccgcccactaccagatgggcgctcagccaggacacggtcagaatacacgcatagacgcacaactgcatcagcggcatgttgaaggcgatgagcttttccgccttggaaaagtccatatagatctcctgggagaccttcccgaatttttccttctcgtgctcctcacgcacaaaggacttcaccacccggatgccaagcaggttttcctgtaccacattgttcaagtgatcataccgcttgaacacccgctcaaagatggggtgggctccggtcataataaagaacaggcccaggcccaggatggggatcaccaccaggaagaccagcgccagtctggggttgatggtaaaggtgagcacccatgcacagataagcatgatgggacagcgcacagcgatgcggatgatcatcataaaggccatctgtacgttggtcacgtcggtggtcaggcgggtaatgataccgccggtggagaatttgtcgatgttggaaaaggaaaatttctgaacattccgatacatctcccggcgcagattacgggagaagccggtggccgcccgtgcggcataacggccggacagggcgcccagcagcagagccgccagggccatgaggaccacaatgccgccgtagtagaaaatacgttccatatttcccgcctcaacgccctgggtcagcagacggcctgtcatcatgggaatcaggacatcaaaggccacctcgccgatgacaaagatcggcgtcagaatcgtgtcctttttgaactcctgaatacagctcacaagtccgcgttttttcttcatgcacattcctccttggggattgattcgcttgctaactgttagcctcctcacagtctttgccgcaggtgcacccggccggaagtacagacggctccatcaggttctgcttcatttttgcaatggtcatcatgaactgctgcaactcctcagcgccgattcccttggtcagcgctgcctctacctgtgtgatgcgcgaggcaatctgctggttcagggcctccgctttcggcgttgccatcacctgcttgagcctggcgtcacgggatacggagcaccgcatcacaaatccctcctcctccaggcgcttcagcagcctggacgcggtggagcggcggatataaaacgcctcctccagatccttctgaaagatttcctgatcccgattatggcacagaaatcccagaagcatcccctgcatctcggtaaaaacatcgcattccggctggccggagagttcccagaccttgcgccggatcagattggacagcgccttgacctcgtaacccgcatggcgttcttgccgcattcagacacccccttccatgcaagctgttttacagagtttattttagttatcttgctaacagttgtcaatgagcaacatttacaaaaagaccctccggtaaaccggagggtctttccattcagctcagcctgtccacggtgacgccgttcatcaccgcctgaaatacggctttgtccacgccgctgctggcagccgtcctgtccagcaggatgccgctgccgtccttcagaggggccgacagtgcgaaataggacagataggccacctgggcccgcaggaaggggctgcctgtcagcttggcctgttccgcagcgttgagcacaccaaactccacgctcttgcccacggcattggcccaggagaagtcaggcgatgccccgctgtccgagtagcccagcgcccgcagaagaaaggtcatgtactcccctgccgagagctgtgcatccggtccaaagtagcgctgtccaccggcactgatgttgttgcccttggtatagcccttttcataggcataggccacatagcggtcgcaccaggcaggggtgtccgcaaaggggttggccgctgtgctgctcagcgcagccccctcctccccgatcaaacgcaggaacatgaccagtcctacgatacgggtaggagcctgctccagatcatacccggagccgtaggccgttccagtgccctggaacagccccatctgctttaatgcgtcggccagagcattatagtccagccccgctccggaggacacggtatagaagccctctacgcccaaaaccgcagtatcagaggtgattgtcactgccgctgtggtattttcggccgctaagacgcggtgacgtgcggtcagcgcggtgccggaggcgacggtctgccccaccgtaatatccaccacactgccgccggaataggacacggttccgcttccagccaggagcagcagcccggaaccggcaggcaggctgaccacgtctccccttttaaagcggaaatccgtgattgaggcggcatagcactgttctccacctgcccgggccagataaccgctgtgcctggcattcagatccgccagcacagagtcgtagacggtctttgtctgctccgcgatgcgtgtctccgcctgccgcagtacgtccggaatataagtgtcgttcaggtagccctgcgttacaaggctctcccctgttcccgtatcggcggcatatactgccgcacagcctatcaggatgaccagggcaagcaggccaacggcaagtctcttcatggtacctccgaaatcatatagctcagcgccaacaggctgtcggcaaagtggacgttctcaatcactatgtccggcgcgtccaccgtcagctcaatattggtgaaattccagattcctttcacgccggaggccaccagccgaccggcgatccggttggccacgctccggggaaccgtcagcaccccgatgctggccggatgctggcccagatactcctccaactggtccacgtggtggaccggcaccccggagagtctctgcccaaccacatccggcgccacatcaaaggcggccgaaagcgccacaccggagcgctcgaagtgaaagttttccatcagggcccggcccaagttgcccgcccccagaatgaccgcgttgtggccgcggttcatacccagaatgtcggaaatctccccccgcagattttcaatattatagccgtagccctgctggccgaacccgccgaagcaggagagatcctgccggatctgtgaggcggtcagccccatggatttgcccagcgcgttggatgaaatgcgctccacaccggccaaatagaggtcgttcaggtggcggtagtaccgtgggaggcgacgtatcaccgcactggacactttatcttttttcatagctccatcactcttcttcttgttccaaagcggtaccgcacgtaactcgcccgttccgctgcaagattcctattcagtttactcgaaagaggggccgatgtcaacgttcttttccctggaaccgccttccggtccggtgcatagagtgaggaaaaggaggaatgccaattggcctcgattggaaccattgtcacccgcgtatatacctcccgggcccagctcccggtaccgggcgctactgtagcggtgacgcagagggcgggcggcgggcggcatacgctgctggccttacgggtgacggacgaaaacggacgcaccgcgccgatccgcgtcgccacacccgagccgtctgccagtgaatccccagggacagagtcccccttcgccgtctgtgacatctgggtggaggtaccgggctatgagatgcttctggtggagaatgtccaggtctttcctaatacggaaacactacaggagctggagctgattcccctgccggagcagacctcgtcgtctacccggggggagatcgtggatattccaccccaggatctgtaaggaggtacccccatgccgaccacacctgtaacgccctatgtcccacaatacatcaccgtgcatctgggcgcccccagcgccgctgcggaaaatgtgacggtttccttcccggaatacgttaagaatgtggcctccagcgagatctatcccacctgggagccggcggctatccgggcaaacatcctggcgatcatttcgtttgccctcaaccgggtatataccgaatattaccccagccgcggctaccccttcaacatcaccgccagcacggcctacgaccagaaattcatcaaagggcgcaacatttttgagaacatcagccagatggtggatgagatcttcaattcctacatacggcgcaccggctttgtggagcccctggcagccaaattttgcaacggcaccaccaccacctgcgacggtctctcccagtggggcagccaggccatggcagagcagggcgccgactccgtcaccatcctgcgaaactattatggcgacaatatcgagatcgtgaacaatgctcctgtcatgggtatccgcagctcctaccccggaactccggtgcggctgggcgaccggggggagccggtggtgcgcatccagaccatgctcaaccgcatctcccgcgattaccccgctattccgaaggttcagccggtggacgggatcttcggagcgtccaccgagcagtcggtcatcaaattccagcagattttcagcctgacgccggacggagtcgttggaaacgccacctggtataagctggtctttctgtacgtgggcgttctggaattggcggagctggtcagcgagggtcagaccttctacaccaccttggtgcccgtcaaccgccccgataccatttccctcggcgacaccggagaaaatgtcaaggtaatacagtaccttctctctgtggtggcggagttttataataacatccccccggtggctgtggacgggattttcgggcaatccacccaaaacgcagtcctggctcttcaacagatggctggtctgtaccaagacggcgttgtaggcgaggacacctgggccgcactctaccgattttatgtcggcatagtggataccatgagccaatataccaatgtcatcccagagcagttccggccggagcttcccgagagcgaagccaccagcctgacccagtaccccggccaacccatgacactgggcagcaccgacgagagaggagaagacgccacatgattcgctcccaactccacctgattggacagcccgtacgcagcctccaaaccatgctgcgcaccatttctttcgcttaccccttcctcccccgtctcacgccggacggaattttcggcgaacgcaccctagaggccgtcatgctctttcagagggaatttttccctccggtcaccggacaggtaaaccaggccacctgggacgctatcgtttccttgtatcaccaggtggtttcccgcctcactccgctgcccacccgcagctttccaagtcctgagttttccgtcgcaccgggtgaggccagcgttcatcttaacctggtgcagtccatgttctgcgggctgtctcgggtcctgaacggcgtggaaacctgtgatgtctccggggtaaacaatgccgccaccgagcacaacatcaagtggattcaacatctgaatcaccgtccggaaaccgggacgctggatcaggagagctggaataccctcagccgcctctatactatgtttgtcaccagcgcccagtcgccctggactacgcggcctgagctttttatgccctgacgcggcatatatgtgtaaggtgggtgccctgtccatagcagggcacccaccttgtctgcagtttcaactacaggttacagtaccagactgggagctgcataggtgcggcccgccagctcactgttgagcatgtagaggcctttggcatcgtcgccgtagagctccatctttttgatcatatcctcggcggtcttctcctcctcgccctgctctttgacaaaccaatccaggaactgcatggtgcggaagtccttgaccccataggctgcatcgtagatcgtgtgaatcagattggtgacatactgctcatgggccaggccggccttgagcacctccagcctgccgttgggggcggcggtgggcctggcaatgccctccagcaccgggcggtggctgttgttctggagatactggaacataagcatggcgtgatcccgttcctcctgcgcctgcaccttgtaccagttggcgaagccatccagtccctcgtcctcgaaataggcggagaactccagatacaggtaagcggagtagaactccttattgatctgctcgttcagcagagaggcaactttttcgttcagcataataaatacactcctttctcatctggatggcataagaataccacggattttattctgttacaactgtaaattccactcagaaattcctctgcgccctaacaatggccgtaggcaacagaggacaggataccggttaaaacagtccgtcgaacagggtaatctgactcgtatccggcatggcccaggggcggccgcgccgtccctggggtcccgtttccctccatctggcgggacgaaatcaattcgccccgccatcgaggttttgcctgcggcaaaacgctcggacgctacaggcagcggacggcatgccggttaaaacagtccgtcgaacagggtaatctgactcgtatccggcatgccgtccagagcaccagcggccttgagttgctcgatgtgggtcttggagaccttgggacaggctgcggaaaactcctcgatggatataaaccgctttccctcccgctgctccatgatagaccaggccgccgtctcgcccagaccaggcacagaggtgaaggggggcagcaggcttcccttctcattgtctggcaggaagttgaccgcgtgagagcggtagagatccatgtgctcaaaggtgaaccctcgcagatagaactcatagaccacctcaagggtaaccaaaatatcctcctccacgggagagggcttctccttgctctcaatctcccgcattttagccttgcacacatccatcccctggcacatgaaggtggcgtcgaaggccttggcccggatggagaagaaggcggcgtagaaggccagggggcggtggaccttgaaccaggcgatgcggaaggccatcatgacataggccaccgcgtgggccttggggaacaggtacttgatcttcttgcaggagccgatgtaccagtcgggtacgccggcggccctcatctcctcctccgccccatccggcaggccccggcccttacgcaccgactccatgatcttgaaggcccgcttctccggcatgccgcaggagatgaggaagagcatgatgtcgtcgcggcagccgatggcctggccgaccgggacgccctgatccacaatcagatcccgggcgttgcccagccacacgtcggttccgtgggagaagccggacaggcgcaggaggatgtcaaactcgtggggctgggtgtccaccagcatgccgcgggtgaacttggtgttgaactccgggatggccacggcgccggttgggcccaggatggggtcgtccacgaagcccagcacctcagaggaggtgaagatgctcatggtgtcccggtcgtccagagggatcttttgcggatccaccccggtgagatcctggagcatgcggatcatggtgggatcatcgtggcccagcatgtccagcttgagcaggttggactccatggagtgatattcgaagtgagtggtaatgatgtcgctgttgggatcgtcggcggggtgctgcaccggacagaagtcgtagatctcccggttctgggggatgaccaccatgccgccggggtgctggccggtggtgcgcttgacgccggtgcagccctgggccagccggttctcctccgcccggtttaccgtccttccccgctcatccatgtacttcttgacatagccgaaggcggtcttttccgccacggtgccgatggtgcccgcccggaacacgtgggtctgcccgaacagctcaaaggtgtaccggtgggcgttggcctgatattcgccggagaagttcagatcgatgtcgggcaccttgtcgccgccgaagcccaggaaggtctcgaaggggatgttgaagccgtccttggcgtagggcgttccgcagacggggcacaccgcgtcgggcatgtccgcgccgcagccgatccccttctctttggcggtgtcgaagtccgagtgcttgcacttgggacagcggtagtggggcggcagggagttcacctccgtgatacccgacatgaaggctaccagggacgagcccacggagccacgggagcccactaggtagccgtgggccagggagtcctgcaccagcttctgggccgacatataaatgacgtcgtacttgcacttgatgatgtcgcccagctcggcattgatgcggtccaccacgattttgggcggttcctcaccgtaaagggcttttgctttcccccagaccagactggtcagctcctccgctgagttctcgatcttgggggcgaacagcccctggggcagaggcactacgtcctcacaccagtcggctaccagattggtgttgcgcaccaccacctcataggccttctccttccccaaataggcaaactcctccagcatctcggtggtggtcttgaagtagatgggcagagacgagtcggcatcttcaaagcccttggaggccagcaggacgtggcggtagatctcgtcctccgggtccaggaaatggacgtcgccggtggcgcacacaggcttgtccagcgcctcgcccagggatacgatggtgcggttgaagtccttcagctcctcctggctctgcaccatacccttgcgcagcatgaaggcattgttgcacagaggctgaatctccaggaaatcgtaccaggaggcaatgcgcttaagctccgcaaagtctttccgctttacaactgcttgaaacagctctccagcctcgcaggccgagccgataatgagtccctcccggtgctggttgatcaggctcttgggcatgatggggtagcgtttgaagtggtccaggtgagaggccgagatgagcttgtagagattgcgtaggcccagttggttcttggccagcacgattaggtgcttgggctggcggcgggccttgcccccggtacgcagcctggccatagccggattgatctgctggagggtatgtacacccctgtcccgcagcatctcaaagaaaggtaccagcatatagcccaccgtggccgcgtcgtcataggcccggtggtggttgaaggcaggcagattcaggtgctccgccacgatgtccaacttgtgcttgcccagctccggcagcaggttctgggccagaatcagcgtgtcgatggaggtgctgtcgaaggggcggcccatgcggcggcacccctcggcgatgaagcccatgtcgaactccgcattgtgggcggccagcgggcgctcccccacaaagtccagaaaggcatttatggcctccgcctgggagggggctcccctcagcatctcgtcggtaatgccggtaagctcggtgatctcgcgggtcagaggccgttcaggatcagcaaacatggagaactgctccaccacctccccgttccgcagtaccaccgctccgatctcggtgattacatcccgccgcttgtccagaccggtagtctcaatgtcgaaacagacgatatcgcctgtaaagtcttgttccttgtccccgtgtaccaccacccggtcgtctacgtcgttaatgaagtacgcctccacgccgtaaagcaccttgatcttcttggccgagtgccaggcatcggggaatgcctgggccacgccgtggtcggtgatggcgatggcccgatggccccacgcttccgcccgcttgaccacgttcttgtccggccccgccttggggctcacttgggtgagggcatccatggaggacatggtggtgtgcaagtggagctccacccgcttctccggcgcgtcgtcggtcttcatgggcttggcgctctccatgatggcgtagggctccagcaccatgtcgccagtgaagcggtcgatgttcagcttgccctggatcaccagatgctggcccttcttcaccccgtccacaatgcccttcccctcgtcaccggggaaaaacttggacacccgcaccgagccggtatagtccgtcacatcgaagcacaccacccatgcgccccgctttttcagctcccggtgatccacggcaaacacgtctcccttgacgatgacggttcccatgtccagctccagggtgctcatggggatgctctcccgcttgatttcgtgcttgccgtagagtagctttcctctcgggccgccggaggccgcctttttctcccgcgggctggcagttttgagaccagccagagctctccggcggatctcctccgtgcggcggaaggccgccatggcatcctcctccaccggggcggccgggggcggaggaggaggggcgctggccgcaggagccggttcagccgccacaggagccgatgtgggagcagtcgcggccgccgctcccatctccagctccacccgctccacccggtaggccaaggccaggctcttctcgatctggtgccgcaggccctcctcgggcattcgagggcactccaccttggcgcggatagagcgggccgccttatcgatcaccgcccccgtgaccagatagccgcctgccagggccgccagctcttcaccgggccgccaggcggaaaacaaattcaaaaagggaatcttctgtgcctgtgacatggttgaaacgctcctgcctcctccgtcaaagttcctcaattagtgcgaaaagctcgtccaccagggcctcctggggaacctttttcacgatctctcccttgcggaagagcaggccctccccgttgccgccggcgatgcccacgtcggcggcggaggcctctccggggccgttgaccacacagcccatgaccgccacggtgatgggcttgtccacggccttaagccgctcctccacctgggtggccaggccgatgaggtcgatacgggtgcgcccgcaggtagggcaggacaccagctccggtccctccttccgcaccccggcggccttgaggatgtcccgggcggcgtatacctcctccaccggatcggcggagagagagacccgcatggtgtccccgatacccatggccagcaagccgccgatgcccaccgcggatttgagggtgcccatgcgcagggtgccggtctccgtcaccccaagatgtaaaggataatcactttcccgattcatcaggcggtaggccgccatggtggtgcgcacgctggaggacttgagggacacgcatatgtcggtaaagtcaaatttctccagcaggcggatatgtccaaaggccgactccaccagggcctccggcgtcaccccgccgtatttggccaggatgggcttctccagggagccgccgttgactccgatacggatgggaatccccttttggcggcaggcgtcggccaccgccttcacccggtcctccccgccgatgttgcccggattgatgcgcactttgtcgcacccggcggccacgcactccagggccagccggtaatcgaaatggatgtccgccaccagagggatggggctccgctcccgaatggcccccaccgcccgggcggcggccagatcgggcaccgccacccgcacaatctcgcaccccgccgccgccagacgtttgatctgctccgctgtggcggacacatcgtcggtgcgggtgttggtcatggactgaatggtgaccggagccccccctccgatggggacgccgcccacgcgaatctgtctggtcataggacaagcctccctacaggatcaatttgtttacgtcgctgacggccaccaccaccatcagggcaatgaggcagaagaagcccgccatattgatatagcccaggtacttctggtcgatacgcctgtgggtgaagaagtggtaaatgccgcccacgagtaggaaaagaatctgcccgccgtccagagcggggatgggcagcaggttcatcaccgccagattgatggcgatcagcgccacaaagctgaaaatattgagcagagccccggccattccggcggcagccgccccctgctggcccacctcaccggccatggcgaagatgccgatggggccggccatgtcgttgaggctcaccgcgccgcggatcagatcccccagactgagccataccgttcgcacgtagtcgatagactggtaccaggcgttgcgcagggtgcccaggggcccggcctcccggagctcccccaccatgactccccgcttcaggctctgctggccgctctcgtcggtgagggtacggtagggcaggtgcagagtgcccagatcgagccgccggccgtcccggagcacctcgacggccacattctcccccgcccggcccaggaaaagaatcgcatcgctctggaaatagatgcggtgcccgtcgatgcggtagaattcgtcgccgggcagcaggccggtctcccgaatgtcctccgcccccggcagataaccgctgaccaccggcgcggacggactccccgccacggaaaagagcaccagcaggatcaccagccccgtcacaaaattcaaaaatgctccggccaccagaatgatgaattttttccacgccggcttaccgctgaaggaccggggatcgtccgaggcctcctcctcaccctccatggagcagaaccctccgatgggcagggcccggagagagtaggtcgtctccccccttgtcctggagagcagcttagggcccataccgatggcgaactcctccacccgcacccccagggtcttggccgcgatgaagtgtccgaactcatggatggcgatgagcgcgccgaagagcaggatggtaatcaggatgaacaggatggtcatagcatcgctccttactcagtgcgtatcgggccggtgtccccgcacggcctcccgcgccgcctgatccgcgtccagaatgtcccccagggagggagactgcaccgcgggaaccgcggccatggcgtaggccacctgctccgcaatgccggaaaaagagagctgtccggccaggaactgccccacggcctcctcgttggccccgttgagcaccgccgtggcgctgccgccggtgtgggcggcctccagggccagggccagacaggggaacgccacatagtccggcgcatggaaggtcaggggcgggcaggacagcaggtccagcggctctgccaccgccgcaacccggccgggccaagtcagggcgtattgaatgggcaggcgcatatcgggcacgccaagctgcgccagcaccgcatgatcacagtattccaccagggaatggactatactctcccggtgaatcacaatggagattttttccgggggcatgtggtaaaggcgcatggcctcaataaattccagtcccttgttcatcatggtggccgagtccacggagatcttggcccccatattccagttgggatgggccagagcctgctctaccgtcactccggcaaggtcctcccctttccatccccagaaggggccgccggaggcggtcagaatcaggcggcgcacctctcccctgtcctggcagccctggagacactggaagatggcggagtgttccgagtccaccggcaccacttgggagccgctccatgcagccgcatcgctcaccagctccccggcgcacaccagtgtctccttgttggccaaggcgatgcgcttaccagcccggatggcggccaaagtgggacggagtcccacgatccccaccacggcggtgagcaccgtgtccgccgcctccaggctggccgcctccagcaggccctccatcccctccgccacgcggatgggcgtgtcagccaggcgcaggcgcagggacgcggcggcctccgggtccatcatcaccgccagctccggctggaagcggcggcactgcttctccatctgctccacgtcccggttggccgttaaggcggccacacgcatgccacaggcggcaatcacgtccagtgactgccgcccgatggagccagtggagcccagcagagaaatacagcggttttgttccatgctatgctcctcccacggcgggcaggaaccggagcaacaattcgatcaggggcgcgcagaagatcacgctgtcaaaccggtccagcacgccgccgtgtccgggaaaaatgttgccgaaatccttgattccgtactgccgcttgatataggaaaatgacaggtcgcccatctgggagatggcgctgcccagggctccgtagagggccaggtacaggtagttcacagtatagccgaaggcgaagcggagcagcacgccgtacagtaccgtgcacaccaccgtccccacgaagccgcccacggccccctccaccgtctttttaggagagagctccggcgccagcttgtgcctgccgaaagccatgcccgcaaacagtgcgaaggcatcgctgataaaggccgccaccaggggcaggatgagcaaaggctcccagtgctccatctggcgaatgcgcaggaaggaggacaggaagaaggggatcaccacagtcaggaaaaaggcgcctcccagcttctccagagacaggcgcttgtggcttgcgatggcctctgcaaagagaagcaccacatacacgaacaggccgcacagcgcgggcagaggccgcccgtcatagtagacccagaagggaatcagcccggccagtatgatggagtagccggagatgcgggtatgcttcaaaaagccggtggaccagagcacctcatgcaccgcgatcatggacagcccggcaatgaggaggcacagagcccagggatacgcgggagaaatcaggtaaaacagcaccagcaggagcgggatgaaaataaccgccaccatgattcgcttacccactcagacacctccaaaacggcgggaacggccctggtaggccgccaacgccctatgcagctcctctttggaaaaatcgggccacagtacgtcagtaaaatagaattccgcataggcggactgccacagcaggaagttggaaatgcgcacttccccgctggggcggatcaccagatccgggtcgggtacaccattggagcagaggtattcggaaaacagcacctcggtcagctcctccggtttccgtcctcccgccgcacagtctgcggcgaaatgtcgggcggcccgaacgatctcgtcccgtcccccatagttgaagcagacgttgacctgcatcccctcataccgctcggaaatctcgctggttttccggcacatatccttgagctcctgaggcagcggctccagatcaccaaaaaagtggagcttaattttgtccttctccatcttttcgatggactccagcagatactttttcagcagacccacgatggcggaaacctcctccagcgggcgcttccagttctccgtggaaaaggcgtacactgtaaggtactccagtccgatcttctgacaataggtggcgatgctgcggaaagtctctgcccccgcggcgtgccccgccgtacgaggcaggccacggcgcttggcccagcggccgtttccgtccatgatgattgccacgtggcggggcaggcggtcaaaatccacctgtgcctccccgctctctttcgtttttaagaatgacatagtttatcctacccggtcccataaaattccggtgcgggacatccaggtgtcccgcaccgtgaggtctatctgctttacaggcttagaccgccatcagctctgtctcttttttggcagtgagctcgtcgatttgcttgcagcgcttttcggtcatgtcctggagctccttctcatagtccttccggtcgtcctcggtaatctccgacttcttttccatggccttaaacttttccatggcatcccggcggatgttgcggatggccaccttgccgttttcgccgtacttcttgacctgcttcgtcagctccttgcggcgttcctccgtgagctgcggaaaggcaaggcgaattactttaccgtcattctgtggattgatgccgagatcggaggtctggatggccttttcaatggccttgagcagggtgctatcccaaggctggatcatcaggctcctggggtctggggaggagatagccgctacctggttcagaggcgtgggagcaccgtagtagtccacggtgatcttgtccagcacggcggcgttggcgcggccggcccggacgctggcgaaatcgctcatgaccacgtcaatggtcttctgcatctttgcatcgaattccttgttgacttccttcatatcacggttcctccttgacaatggttccaattttctctcccataacgacccgcaggatgttctccgggtccttcaacgcaaacagaaccaccgggatcttgttgtccatggacagggacgtggcggtggagtccatcacctgcaggtgctgggccagcatatcgtcataagtgatggtgtcatacttgaccgcagaggggtccttcttcgggtcggcgctgtagacgccgtcaatgttcttagccagcagaatggcatccgcgtcgatctccgcggcccgcagcaccgcggccgtgtcagtggagaaaaacgggttgccggtgccgcagccaaagatcacgacccggcccttctccatgtgccggatggctttggagcggatgtacggctcggccatggcgcgcatctcgatggcggtctgcacccgcacgtccacgcccttctgctccagcacgtcggccacggccagggcgttgatggtagtggccagcatacccatgtggtcggcgcgggtgcgctccatccggtcgccgccgtccttgacgccgcgccagaagttgccgccgcccaccacgatgccgatctgcacgccacaggctacgcacttcttgattacgtcgcacacactgccgatcacgtcgaagtccaggccacggctggcctctccggccagcgcctcgccgctcaatttcaaaaggacccgcttatactgcggttcactcatacgttcaacccctttatacggtattcagtcccttttattttaatatagttttccacgtttgcctaggggttaggccaaagtttttacaaattattcgtaatcggagttttgccgctcacccgttgaagggacatcctccggccaagcctccagcttcgcccggaaagagatccgccggggcgtctccatatcgtcgaactggaccaggtgggctccccggttcaggtccacgtccagcacccggcccagcccgaacacgaaatgccgcaccctctggcccaccggaaggagcaccgcgccgtcgtccgggggcagggcgcggttgctgctctcggcgtaccccctggccgccttcagcaggccctcctggggctccggtacggggatgaatgtcccccacatgtccagcaggaaccgggaagagtagcggggtgagccgtcgaaattcgtcccgtccgcctcggacaggtacagccccttctctgcccgtgtaaccgccacaaaggccagcctccgctcctcctccattccctgacgggtgcgcaccttccgtgaggggaagatcccttcgttcatgccgcacaggaacacataggggaactccagccccttggccgcatggacggtcatcagcttcacacggtcccccacctccccggtgtcgctattggtaaagagggccacatgggccaggtagtgctccagggtacattcctcgccgcaggtggtctcatactcatagaccgcctgcttcagctcggccagattgtccagccggtcctggcttccctcggtgcggagcatcatctcgtagccgctctcgttgagtacggcggacagcacctctgaaactggccgcccctcgcattcggtggaaagcccctcgatcaacgacacaaaagaccgggcccgcgtccccttaaacaggggctcgtccaggcactcctgcagggcgcggtatagagggcagccctgctgcgccgcgtattcctccagaaaagccatccgccgcttgcccaagttgcgcttgggcgcgttgacgatgcgccgaaaggacagatcgtcccggtaggcgagcattcgcagataggaaagggcatccttgatctccatccggctgaaaaagggcacgccgctgtagatcgtatagggaatcttctcacggagcagaacgccctccaccgcccgggtgacatagtgggcccgatagagcaccgccatgtcccggtagggcacccccttctcccgcagcttggacatctcacccgccatccatccggcctccgtcaccgggttctccccgaaatggcacaggacgggcccgccggatggaagggtggggcgcagctcctttgggatacgggcggcgttttgtgcgattagggcgttggccgccgacaggatctccggtgtggagcggtagttttccgtcatcagaatggtctttgtgcccggaaactgcttgtcaaaatccagcaggtactttacgttggcccccctccaggtgtagatggtctgatccggatcacccacgatgaacagattcctgtgatagccgcagagcacctccatcagtccatactggagcccgtcaatgtcctggaactcgtcgatcatgatgtactccagccgcttctgccacttgagccggatagcctcattttcctggaagatatggagggtgaatttgatcaggtcgttgtagtccagcccaaagcactttctctcttggtagaggtagccgtaaaagatcatatccccggcctgtaccgcgtccagatacctctgcttcagagcgtccagcgacagactaagcatgtcccggtaatactcaggttccttgaacagcttgcggatttcgatcatatcccgcgccgcccggaaggtcatatcccggaggctgaggccccgctcctcatagatcatctgcagcatggcgtcaatgtctgcgttgtccagtaccagaaagctctttggataccccaccacgtggctgtcctcctggagcacggagacgcagaagccgtgaaaggtgttaatgtagcccgtgtcgtcgtccccggtcagccgatggatgcgctgacgcatctccgcggccgacttgttggtgaaggtcacgcacaggatattccccggcaggatacccagctcattgaccaggaacgcaaaccgatgggacagggcgcgggtcttgccggagcccgccccggcgatcacccgaacaaagccttcggtcgccgtgaccgcctcccgctgcgcctcattcagcccctccagcaaatcctccatgataccgcctcctgatagaacatctgttttctttattatagcaggcggggagacaccactcaagaggaaaagcggcggcccggactgcctcgccgaaccgccgcattctctcacttgagcttctttccgtcctggaaggcgttgcccaccttctcccccagcaccaggtaggcgctgttcgccatgtcgaaggtgatggggcgcagcctggccggatcaatagtgccgtccgcgttcaagatgcgctcgtctgcactgacgttgacgatctcgcccaccaacagctcactctcctcgtcaaagctaacaaaccggcactccagggccaggggcagctcgtcgaccagcggggcgtccacatgggcactcttggtcacatggaaccccgccctggccaccttgtccggcacctgattggccgacacaatgcccaggtagtcgcactccgtcacgtggtccgcatccgccatgctcaccgtgaaggccttccgggccaggatgtttttcaccgtcttgtggctggcgctcagatacatggccacccgcttcatgtcggcaattccgccccaagcggcgttcattacgtccggggtgccgtcttcgccgtaggtggcgatcatcaagacaggctgagggtacaggaagggtttggctccaaaatctttcctcatgattgttgtcctccgttttcattttataatgtagtacttagtatagcacgtcccccgcgtcaagcacaatccccctgcaccaaacagaacccgctgtcacggaaaagcgccggacactgagcgtccggcgctcgaagccaatctgcggtttacttgcccagctgcttggcgatctccccggcgaagttccgccccacccggcttgccgggcggggtgccccgattttcattcgattggggcggaatgaatccgccccaatccaaggctttgcctccggcaaaacgcttgtacgcgccatgcggcgcggcccgccggaggcgggcgcaggagaacgcgcaggcatggaaaagcgccggacactcagtgtccggcgctcgaagccaatctgcggtttacttgcccagctgcttggcgatctcctcagcgaagttccgccccgattttcattcgattggggcggaatgaatccgccccaatccaaggctttgcctccggcaaaacgcttgtacgcgccatgcggcgcggcccgccggaggcgggcgcaggagaacgcgcgggcatggaaaagcgccggacactcagtgtccggcgctcgaagccaatctgcggtttacttgcccagctgcttggcgatctcctcagcgaagttccgccccgattttcattcgattggggcggaatgaatccgccccaatccaaggctttgcctccggcaaaacgcttgtacgcgccatgcggcgcggcccgccggaggcgggcgcaggagaacgcgcaggcatggaaaagcgccggacactcagtgtccggcgctcgaagccaatctgtggtttacttgcccagctgcttggcgatctccccggcgaagttccgccccgcccggcttgccgggcggggatccccgattttcattcgattggggcgaaatgaatccgccccaatccaaggttttgcctccggcaaaacgcttgtacgcgccatgcggcgcggcccgccggaggcgggcgcaggagaacgcgcaggcatggaaaagcgccggacactcagtgtccggcgctcgaagacaatctgtggtttacttgcccagctgcttggcgatctcttcggcgaagttccgccccacccggcaagccgggcggggagccccgattttcattcgattggggcgaaatgaatccgccccaatccaaggttttgcctccggcaaaacgcttgtacgcgccatgcggcgcggcccgccggaggcgggcgcaggagaacgcgcaggcatggaaaagcgccggacactcagtgtccggcgctcgaagacaatctgtggtttacttgcccagctgcttagcgatctcttcggcgaagttctcctgcttcttctcgatgccctcgcccttctcaaagcggacggcgttcttgaaggtaatggtgccgcccagagtcttggcaacggaggcgatatactgctccacggtcatggcgttatccttcacgaactcctgctgcagcaggcagttctccttgtagaacttgcccagcttaccggcgacgatgccctccttgaccttctcgggcttggaagccatcttaggatcgttctccatctgcaccaggaggatctttttctcctcatccagggtggcctggtcaacctggctcttgtcccaaaagcgggggttcagagcggcgatctgcatggccacgtccttgcccacggtctccacctgttcggcagtcaggccagtctctaggtttaccagcacgccgatcttgccgccagcgtggacatagggcacggagatgccatcggtaaagaaagcaaagcggcggaccttgatgttctcgccgatgacgagcaccatctcctgctgctcctcctgcacggtgcggccgttgccgtaggaaagggccatcagggcatccaggtcggcgggcttgttggcggccacaacggcggccacgcccttaacgaagtccacgaacttctcgttcttgcccacgaagtcggtctctgcattgacctcgaccaccacgccgacgccgttcaccacggtggcataggccatgccctcggcggcgatgcggcccgcctttttctgagaggcggccagacccttctcgcggaggatctcaacggccttgtccatgttgccctcggcctcagtgagggccttcttgcagtccatcatacccacgccggtcatctcgcgcagggtctgtacgtcttttgcagtgattgccatgatcacattacctccatctcaaatatcaaaaggagcgcccgcccgcgcgggcgggcgctctcaacatcacggtttggggccggaattactcggcggccgcttccttctcagcggaagcctcggcagcgtcctggccctgcttgccctcctggatggcgttggccatcacgccggagatcagcttgatggcgcggatggcgtcgtcgttgccggggatgacatagtcgatctcgtcgggatcgcagttggtgtccacgatggctacgatggggatgtgcagcttgcgggcctcattgatggcattgcgctccttgcgggggtcaaccacgaacagcgcgccggggagcttcttcatctcgaccacgccgcccagatacttctccagcttggcgatctcgcccaggtgcttcatgacttccttcttgggcagcatgtcaaaggtgccgtcctcctgcatcttcttgagctggttcagacgctccacgcggccgcgcatggtcttgaagttggtgagcatgccgcccagccagcgggcgttgacatagtacatgccgacgcgctcggcctcttccttgatggcctcctgagcctgcttcttggtgccgacgaacagcagggtctggccggactcgcccagggagcggacgaagctgtaggcctcctccagcttcttcacggtcttctgcaggtcgatgatatagatgccgttgcgctcggtgtagatataggtggccatcttggggttccagcggcgggtctggtgaccgaagtggacgcccgcctcgagaagctgcttcatagatacgactgccatggtaaaaattcctcctttatttgttgattcctccacccggttcatccgaagccggccaacctcccatttggaaagcacctggcccatcgtccgcgggtgtgcgtaatcacatgctttggtataatatcacatcgttccccgttttgcaaggtttttttcattcccgcgcaaaaaagggcccggatagctccgggccccttcataaagtatatactcagtccttcctccagtaatagttgacctcgttccagtaggtttcattttgaaaatgccaagggccgaaatcaaactggattagagtgccggtccggtcctccccttcatagattcggctgttatcccctgtaaagaccagattctgtatttccgccacatcgatgggggattccagttcgaaacggacatgatccgcccggaaaaaggttcgtcctgcatcatcgtgaaatacgtcctgaacccctcccaccttctcaaaccgggtttgaatcttgcttccgtctgacatcaggacgtacatctgccaagggccatcctgaccgaaggccgcgtcataggccgccccgtccgggatcaccagatccatgctgacgctgataggcgagatggtcaggttctctgccaccgccagagtcacgccgttcagattcacaccgcaccggccctggaagtcgtaatgggtacccatgccaaccagggggacgatcagatcgatgtccataccatccagcatggtgacccattccccctgatactgcatacacagggactggatcccggaaaacagacagtatgcggcatccttcggcatcggatctatatgcccacgaatgataaactccattttgttgtctgtggggtcgctgtcctccacatagtctattgcataccccgcctcgctggagccgataaagctggtgcagctctcgtccctataggctccgaagccgattcccctgccgtccggcccgccccagaggacggcgcggttgaagccctcctccacctggtcgggctcgggcagtaccgtcccctccggcgcggcaaactccaccaggatatagaactgttcctgatccgccgccgcctccttcacggtgacggtggccccggagccgttcttgtcctcgaacacctggttcatctgtacaatccccaggttttttgcctgttcctcgctggtgatgccgtacagctcccggaaggctggggacaccccggcaagtgagacggcccccaccgctcctgtcaggagtgaagcggcggctacgatggccaccaacccgcgataggggaagcgtgggcgcttctcttcctgcccgctcctccgctccagcaggcggcaggtcagcgcctccttttcctccgccgagaagttcagccgctccaactcatcccgatagcctgccatagcccaatccctccaatacatgctttaatttcatccgggcccggctcatccgggtccgcaccgcatcggcccgcaggcccaggatctcccctatctcgttggtatcatatcctaaatagtagtagagcaccagcacctcccggtacttggcaggcagacgctgcacctcttccagcacgccgccctcctccggctgaaacgccgcaggctcggccacggcatccaggcccacagtgcgggtgcgccagggactccggcggacgtttttgcaggcgttgaccgtcacccgcaccatccaggcctgttcgtgcttctcattttcaaaggcacctggatattccagccgcttaagcagcacctcctggcatacgtcctgggcgtcgggcacagaattcaggatggaataggccagcctcaagagccggtcggagtaggtctccaccagccgggcagccagcgcctcctccgcatgctccgccatgaatctccctcctttttctccgtttggaacgcgttcacctgatatacacctcacggctcccaaacgtgacaccctccagcagaaaaaatgccccggttttcaccggggcggcggaacgtatctcttttttaattatcattcaactgcgcactcatggcctggtcgaagtgctggttgatctgcttggtaaactccacggcggcgttgtaccccatcttcttgtggcggttattcatggccgccacctcgatgatcaccgccagatttcggccaggccgcaccggcacggtgagagagggcacctgcacgtccagaatcgtggtgtagaggttctccaggcccaggcggtcgtacatggccccgtccttccactgctccaggttgatgaccatatcgatctcggcctcgtccttgacggcgctcataccgaacaggcggcacacgtcgatgacgccgatgccccgcagctcgatatagtggcggatcagctccggcgcagtgcccaccagccggtcggtgacgttgcgcttgatctccactgcgtcgtccgcgatcagccggtggccgcgcttgaccagctcaatggcggtctcgctcttgcccacgccggactcgcccagcagcagcacgccctcgccgtacacctccaccagcacgccgtggcgggtgatgcggggagccagataggacttcagcgccgcaatgatgttgctcatgagcacgctggtggtgtccgggctgcggaggatggttcggtcgtacttctcggccatctccatacactcggggaagggctcaatctcccgggaaataatcagggccggaatgtcctgggagagcagcagttcgaagctctcccgccgctcctcggaggtcagcccctccagataggtggtctcaacgcggccgatcacctggagccgcttggcgtcaaagtagtcgaaaaatccggtgagctgcaggcccggccggttcacgtcctccgtccggatcgacacatcctcgtaccccgccccgcccctcaggacctccaggcgaaattcctgaatcagttttcccagctttacgctgtaaaggctctccattggcgctacccccttgcggtattattagttatagtataccattctcccctgctcctttgcaacacactttggaagaaagggattttttgaaaaaaatgcttgcaattttcgaaaagctctgttattatatcattcgatgctttatcaagctatcctgacgagcgaggaggtataagcgaatggccaaatgtgaattttgcgataagggcgttgtgttcggcatccgggtgtcccactctcaccgccgctccaaccgtccttggaagcccaatgtgaagcgcgtcaaggcgattgtcaacggcacgcccaagcacgtctatgtgtgcaccagatgcctccgttcgggtaaggtcacccgcgctgtgtaagtttgtaaaaaagggaccagcctttggctggtcccttttttctttggaacgattgcgcctgtccccacatagcatggggacagaatggaggcgtattccatggctgatgctctgtgccgcctgccccgggtcctgctggatggccgccctgccgcccgtgcactgctctgtggcagcaacgcccaccccggcctgcggggcgaggcgctgttttatccctaccaggacggaaccctattgctgatacgcgccctggggctgcccggggacggcttttatgcctgccacattcacgcgctcggcgactgctgcaccgggggcgacgtggcctttcactgcgccggtccccactacgatccggaaggccgcgagcacccgaaccacgcgggagatctccccgtcctgctctccagcggcggccgggcgctctccctcgtgtataccggccggtttcagcccgggcaggtgctgggccggtcggtggtactccacgctctgcccgatgactaccgcagtcagcccaccggcgccgccgggggccgcattgcctgcggcgtcatctcccctgtggcctgagccgggcccgcatggcttgtcatgcgggcccggctttctgctctctattatctattgtatcttgttttgctatcccacggtcaccacccgcaccacggcgtccccgcccagtgcgccgctgtagtacacggtcagctccgctccgtaggatttggcggccgagagggtcgtccagcgcccggtttcttggttgtaaacctctaccccgtcgctgacgggcacccgaaggccttccaccaccacggcctcctctccgtcaaaatcagcccggctcacatcggccttcttcaggctcacaacctccacggcctttccctcggacgacaccgcgatgccacccatggttccgctcctgaccgtctttcccgtgatatatgcctggctagctccgctgctgttctccacggagacggttcggttggtataggtcatgctgccgctgcccccggtctgctccccggcggtcagcaggccgtaggtaaatgcgttccctgtcacatcgtccagcaggaggaggcagacctctccgctttcgtctgtggcgtaaaagtcaatttgggaggcaggtacggtatccatcagaatatcctccagggcaatttccgccactgtgctggaaccggcccgctcgtagagcttcacattctccgacagtggaaggctccccagggtgccgcccgacggatccagggcatactggctcccaccggacaccggatagaccgacagggccccgatcccggtggagctgacccgaaccagctcacccacaccggcgccgtggacgctgagctcacccgccgcagtcagcccgcaggtcagctccaccccgtcctcctgaagcacgccgtagagctccgcccgcttctccgagggggcgcaggcagagatcacctctcccgccccgttcagggtgacggtaatccggtcgcccaccgcgaaggcggacagcccggccgccgccccgtccaccacctccagctccacgcccagcagcgtgatggaggcgggcgatgcggcgttggggctggcattctcataatagccggtcagcatgaccccctcataggccgccgcctcggaggccacgaccagatcgagcgccccggagtccgtataatacagcgtcacctgctcccggccctccagctcataccagcagtcgccgtaggtgctgaccgcgccgtccagcagcaccctggttccgctggagatggcatacgttccccctccggcggcggtgatgccgtccgccgccacctctgccgggcggagggtgcgatgggacgaatcgtccggcaggaagcccaccgtctttcccgcctcgtccagcagcagcgcgcctttccgccccaccaggcgatccggcactgcctccgcaggttcataccagttgatcgtctgattggcatagacctccaccgtgcccagggtgccgtccgccgcctcggcgttattgtccagcagcaccgcgccggtcaccttggaggcgcagaggttgtcgatgtaatcctgtccgtcccggtctgtctgccgcagcacgcggtagagcagcagggccgcgtctccccgggtcaggccggctccgccgtctgcgggcaggccgtccagaagccccagtgccacggccttattcagatagtcctccggccagaaggggccgatctcctccgccgtatagcccagcaaacggagaaccacggttaccgcctgtcccaccgtcaccgggtcgtccgggccaaagcggccgtcgccatagccggagaccagcccctcctcacaggccagattgatatagggggcggcccagccgccgcccggcacgtcggaaaagcgggtacggtaggcgctcccccgcgcctgatccccgtgtccctccgtcaaaacggccagcttacagaactgggcgcgggtcagcgcgtcgtccgggtggtagctcctgtcggagtacccggagacaatacccagtccggagagcacctccaccgcctcggacagctcctcgccgctcacatccgaaaaggccagggcgggcgccgccgcgatcagccccaggcacagccccgccgccagcagcagcgccagaatacgttgtttcatctgtgtttctcctctcgattagtcggcgcgcagggcgtccacgggctgcaaaccggacgccttggccgccggatagataccgaacacgattccgatggcgacagagaaggcgaaggcgcccgccgtcaccagcgcgtcgggatacaggatcagatcatacatggccttccccaaaatgagcgagagcaggtaacccagggcgatgccgatgaggccgcccagagcgctcaggatggcggcctccaccaggaattgtcccacgatctcccgccggggcgcgccgatggacttcttgatgccgatttcccgggtccgctccgtgacggtgaccagcatgatgttcatgataccgattccgcccaccagcagggcgatgcccgcgatgccgcccagtaccacgctcatggaggtcatctcctccgtgctctcgctcatggcggagttgccgttctccagctcatactcccccacgctcgtgtcgatggtctcccccaggaaacgctccagcttcgccatcactgtgtccatgtggtcggactgatctaccttgacagaaaagtgggtgagctgggcggtgcccagtatggcccgatccagggagtaggggatcaccgccatgtcgtccatggagccctcctcgcccccgtccttctggtagtagatccccaccacggtgaagggctcaccgccgaagtagacggtctccccgatgggatccgcatattgaaacaggctgtccgccacgtaggagccgagcacgcacacccggctgcgccggtcgacgtcaaaggcgctgatgtcccgcccctccttcagggtgtagttcccgcagacggagaactggtcgctgcccaggtagagcgtcccgctgtccagcgtggtggtgcggtatttcatgggcaggcttgtggacagatcggggctcacccccagcaccatatcgcccagctctccattcccatagtcatagagggcgtctatcacatccacagaccggctggtgtcgtaccagttcaccgtgacgttgaccttgttgacgcccagcttctcatagtaggcggtgatgtccgcgttgtagccggacaccagcgccaccagcaccagcacggcggtcacgccgatgatgatgcccagcatcgtgaggaaggagcgcccctttttctcccggatggagtccagggccatgcgcagcgcgttcatggcgccacccgcgccggcggggcgctccagtccaccagcacgccgtcccacaggctgtcgtggacgattctcccatccttcacccgcacggtacggtcggcctgggcggcgatgccgttgtcgtgggtgatcaggatcacggtggttccctcggcgttcatctggcgcatgaggcccagcacctgttcgccggttctggagtccagcgccccggtgggctcgtcggccatgaggatgggcgagcgggcggcgatggcccgggcgatggccacccgctgctgctggccgccggagagctgggccggccggttgtccgccttggcggcgatctccaccttttccagcgcctccatggcccgcgcccgccgctccgccagcgggacccgctggtagagcatgggcagcgccacattctgccagacgttcagggacgggatgaggttatagccctggaaaatgaacgcaatctgccgggagcggatctgggacagctccctctgggtgcgctcccggatcggggtgccgtccaggagatactccccccgggtgggcacgtccaggcagcccagtatgttcatcatcgtggacttgccggagccggaggtgccgatgatggccacaaactccccctggtctatgctcagcgtaaccccatccagcgcgttgacctggttttcctgcccctcggcgtaaattttatagacgtccttcaattgaatcaggctcatacagaatcccccttctcagcccatagggccgccgccgggcatcccgccgcccatgccgccaggcattccgccgccgaaatccggcatctctccgccgctgaagtccggcatttccccgccgcccgggaagtcggacggctcctctccctggctggtggtatccccgccgttcggggccgcctgctggtagcgggtgaatacctccaccccctcctccacgccggagaggatgcgcacatactggctgttggacaccccggtttccaccggcacggcatagaacccgtcgggcaccacgccgtcctccagctccaccgcgttgtccggcgccgcgtccgccttgacgaagaggcaggttccctggctggtgctcttgagggccgcgatgggggccagcaccccctcggactcgtcgcccacggtgatggaataggagacgttgacgccggcggagagggcgcccccgctgggaatggtgatggtgatggggaaataggccacgccgttggagttggtggcctcatagctgatctccgtgacagtgccggtgtaatgggtgtcgctctccgcccccgactgggtgatgtccacctccatccccatggcaatgccgtcgatgtccagctcgtcaatgttggcggtgatggtcatggagtccaggttgtagagcaccaccgcggtctgccccgcctcccgggggctctctccctcccggacattgaccatgatgatcttccccgccagctcagcggtcaccgcgtagtcggagcgcttctcctccgtctccgcgctcttctcctggagctggacaatcttttcctgggtctgggtgatctgcttgttcaccgactccacctgcttctggtagtcggccccgtcgagctggacgagaacggccccggcgctcacctgctcatagtccaccgccccgatgccggtcacctcgccgcccacctcggcggtgagatcctggctgcggcggtactccagctccccctccaccgacggatagagcttttcgcccgagtccgccaccagatagccggcgcccgtcattccctcggtgaaggcgcccggattgtccagggtgacggtgacggcaaagcagtgggtgccctccgccgtcacccggtccaccatctgaatgtcggtgacggttccctcctggttgagcatgaggctggccacggacaccccggccttcatgcccacgtagacctgatcctcataggcgtagctgaaatactgggtcaggcacatctggctgtcgtccacaagggtggccagcttggttccggcggccacattgtcccccacgtccacggccacatcggtaatccggccggcaaagggggctgtcacagtgagggcggcgatctcctcttggagctgggcgagctgctcctgataatcgtccagctggttttcctgctcggtaatctgatcctggtactcctcaatctggtcgtccagctctgaatcatcctgggtgtagagcagctcgcccacctccaccgtgtcgccggcggagacgtatacgccggtgatctccgtctccgaggcggtggtgtacgtaacgctgtccgccggcatggtggttccggtgccggagagcgttgtggacaggctgccataggtggtctgctccgtcaggggcgtctgctcctccccgctgaaaaacagggcctttcccccgagggcggcaccggccgccagggccagaaccagcagcagcgccgccccgcgcctcaccgtcagccgccggccgggcttccgctcgggcggcgcactcccctccgctttcttccgcagtgccatcaactgcatgcaatcgtcctccccttctgttccggtttcggaggccagtatagggggagaaactgaaattactctgaaaaagggccgcgtgagattgttaacactctgtaaatcctttcgtctgccgccccgcctataatacatttcagacagatttcagttctctcccttataatggagaaaaacgcaggaaaggacagaaggtatgcgcatcttgattgtagaggacgagcgccgcctggccgaggcgctgggccagatcatggcggagcagcgctatcaggccgacgtggtgtttgacggggcggatgggctggactacgccctcaccgggcagtacgacgccatcgtgctcgatgtgatgcttcccaaggtggacggctttgaggtggcccgccgcctgcgctgcgcccacgtctccacccccattctgatgctcaccgcccgggatgagatcccggacaagatcgcggggctggatcacggcgcggacgactatatgaccaagcccttcgacatcggggagctgctggcccgggtgcgggcgctcacccggcggcagggcgaggtgatcggcgagcagctcgccgccggggatctggtgctggacacccccacccgcagtctgcgctgcggggaaaaatccgtccggctgggcttcaaggagttcgacgtgctccgcctgctgctggccgccccccgggccgtcattcccaaggaggacatcatctccaaggtatggggcctggagtcggaggcggaggacaacaacgtggaggtctacatctccttcctgcggaaaaagctggcctatctgggttcccgggtgagcatcggcaccgtgcgcaaggtgggctatcacctggaggtgcctgcggtatgatcaagcggctgcggcggaaattcatcctgatcaacctgctgctggtgggcctggtgctggcggtggtgttcatcctctttgtgggggcgaacgtccgtcgcctggcggggcagagcgatgccgccctccggctggccctgtcctggcaggagggggaggggccgccccgctttgaaatcggcggcccgccgccggaggagcgcgagccggacggggcgcaccgcttctccctgatcccggtttttgtggtcaccgtgaaggacggggccattaccggcctcaacgacggcggccaggtggacgtttcggaggagaccgccgccgaggcggtggagcaggcccagtcctccggcgccagtcagggcgtgctcagggagcttcgcctgcgctttctggtggagcgcaggcccgacggcgagctccgcatcgcctttgccgatctgggctgggagactgcctccctgcgcaatttgtccctgctgtccctgctggtgtgggccctggccatggtgggtctctttttcgtgagccttgtcctctcctccgtggccctgcgcccggcggaacgggcgtggcagcagcagcgccagtttgtggccgacgcctcccacgagctgaaaacccccctcaccgtcattctggccaataccggcctcgtcctctcccatcccgaagacacggtggccgcccagtccaaatggctggagtacacccacgacgaggcggagcagatgaaggagctggtggacgatctgctctttctggccaagtcggatgccgcccgccagccggccgaccgggcggagacggccatgagcgaggtggcgctgggctgtctgctccccttcgagtcggtggcctttgaggcgggcgtggcgctgaagcaccggatcacccccggcctgtccctgcgcggagacgaggggcagctccgccggctggtgatgatcctcctggacaacgccgtgaagtacgccgggccgggcggcaccgtcaccttcaccctggagcgacaccaggagcggctgcggctggcggtacacaacaccggcgagcccatcccgccggagcacctgccccacctcttcgagcgtttctaccgggcggacgccgcccggaaccggagcgggggcggctacggcctggggctggccattgccaggagcattgtggagggccatcacgggcggctcaccgtcaccagcaccgccgcggccggcaccaccttcaccgccctgctcccccgccggtgacggttttgcttgtcagaacggcgcggctgttgtaaaatgggcctgttccagaagaagttggaaaggagaaaccaattcatgtccgttactgtaggaagcaagggccgcgccgcgtgcgtggtcaacgatcagaacaccgccgccgccgtgggcagcggcctgctgcccgtgttcgctactccccagatgatcgccctgatggagaacgccgccgtcgacgccacccaggcctccctggaggaggggcagggcaccgtgggcacccggctggacgtgagccacgactccgccacccccgtagggatgcaggtatgggccgaggcggaggtcaccgccgtggacggccgcaagctcacctttgccgtcaccgcctacgacgaggccggccccatcggcaagggcacccacgagcgctttatcatccagaacgacaagttcctggccaaggcccaggggaaaaagaaggggaattgatatgtccattgagacgggccgggcctacctgcgggccagaggctatgaagaccggattcaggaattcagcgtatccagcgccacggtagagctggcggcccaggcggtggggtgcgaacccgcccgcatcgccaagaccctctcctttgcggtagacgggggctgcgtgctcatcgtctgcgccggggacaccaagattgacaacaccaagttcaaggcccagtttcacaccaaggccaccatgctcaccccggagcaggtgctggacttcaccggccacgccgtaggcggcgtgtgccccttcggcatcgataaccccgctgtgaccacctacctggacgtgtccctccgccggtttgacacggtctaccccgccgcgggcaacgccgcctccgccgtccgcctcaactgcgaggagctttttgcgctgtccaacagcgccggatggatcgacgtgtgtaaaaattggcactgattggacactcccgcccttctgtccaatgacttttccgcccggcgggggtatactagagtccaaggggggattttctcatgcgggaattttttcataatatgaagctcagctttcttctggccgcggtgctctacgtcattctcggtctagtgttgctgatctggcctggcgtcagcgccaccgtgttctgctacgccttcggcggcatcctgctgatctacggcgtggtgaccatcgtcagctttttcctgcgggacagccggcagggcagcttcgtgttcgagctcttcctcggtatcgtcgctgcagccctgggcctgttgttcctgctccgcccggtcatcgtggcctccgtcctgcccgtaatcctgggcctgttcatcgtggtggacggcctggttaacctcaaacgggcgctagagctgcgccggatgctctatctccgctggaccgtgcccctggccctctccgccggatcggcggtgctggggctggtgatcgtctttcagcccttcctggctgcggaggccctggtcatgctcatcggcgcggtgctcatctatgaggggctgtccgacctgtggactatcttccgggtaagccagtggaccaaggagtaccgcaagcaccaccctgtggatgtcgacccgattgattttgaataaaccaataaaaaacaactcctgggcacatgcctaggagctgttttttattgactttttccaataacgtttatataataacaaacatatattaaaaacgtttgtgtgaaggtgattcttatggaagagcaggaacttctctggtccgcctccgggcaggagctgatgcggggcgtcgccctgcgggatggacagtaccgctgcctcctctgcggagccgccttcccccagggggaggtctttccccgcgggggccgcttctatgatgccgagtccatggcagccctccatctccgggaggcccatggctccatgctggagtatctgctccaccggaaccccggtctgctggggctgtccgaggttcagttggagctgctccgcatgctcgcggagggctgcacggataaggaaatcgctgcgcagaagagggtttccccctccaccgtgcgcaatcatcgcttcaagctccgggaaaaggagcggcaggcccgactctttttggccctgatggagctgctgcgtaccagccgcatctccagcccggtggataccggcttttgccacccccatcccactgcgtccatggttgatgcccgctacgccgttactgaggaggagcggcaggccatcctggccgcctgttttgacgaagccggcgccctgcgccagtggcctgcccgtgaaaagcgcaagttggtcgtactcagcgccatcgccgagcagttcaagcccggcggacagtatacggagaaggaggtcaaccggctgctgggccggatctatgaggactttccctacctccgccgcctgttgatcgaatacggctttctggagcgcaccgcctccggctccgcctactggcgcaaggagtaggcggtgggccgggctgtcggcggccgggccgccgccctcctgctggccggacggacggtctcccggttcggctcctccttttatctggtcgccctgcctctctatgtgctcgagcgcaccgggagtctgggggcgtccggccttttcttcaccctgaccagccttccgcccctgctggccgttcccttcctggggccgcttgtggagcgcgcccaccgaaaaggattgctgatcctctgtgattttggcgccagcgcgctctgtgcccttctcctgcttttccccggccccccgctccccttcctccttgcgggcaccatgctttttcacctgctgtcccatttgttcgaaattgcatccaaggttctcttttcggagctgtgtccaccggagcgcctctcctccctcaatggaatcaaaagcctgctggatcacggcgcggcggtactggcccctgcggcgggcgcgcttttgtttggactgtgtggattccgggccatcctcctgctgtgcgcgttggcctacggcctctccgccctccaggagtgcttcattccctacgcgccgcgccccatccagcaggcggaaccgccccgcctgcgggccggtattcgatatctgctgggccggcgggaattgttctccctctttcttctggtgatggccctcaatttttttgtggccaacagcgaggagatcatcttccccggtattctggtggagctgtaccagtttccagagtcccgatacggcctggcggtctccgcctccaccgccggaaccctgctggccagcctgttcctgatccgggcggcccacctccgccccctggaacacctgcgcgccctgtttctggtcaacagcgccctgatggccgcccttggtctggccgcgccccttctgcgttccgttccaaagctttactttgtcctcttcttcaccttccagcttttgatcggctggctcaccgcctgcatcaatgtcccgctgatctcctatttccaaacccgggtaccgctggaacagcaggggcggttctttgccctgctcgccttcttctccgggatactgatacccctgggcatctcctataccggagtcctggccgactggctgggtccagccgcggcctatgcctgcaacaatctctgtgtcattgttctggtacttctggtaaggcttccggcctgaagcgaacagagcccgcgggattttatatcccgcgggctttgtttgttgtctcttattcccaggtctgaaactggccgtccagcaccgcgcggcggtggaagatgacgaagtcgggggcggcgtcggggcagtgctcccggatggccgccaccaccagctccgggttgaggccgggattctgggcccggagcaccaggtccagggcgatggtgtcccgccgctcctccacggtggccctggcgatcaggggaatgaggtccacctcggtaaagccgctcttggccttcttgctccttttggtcatcaccagggagtcccgggccagcaaatcccggatggcgctctccgcgccgaagggggcccccgcctcatactccagggtgacgatatagttgacgtagcacagctccttcaccggccgcaccgcctcatagcagcgctggacggtgatgcccgcgggcagggcggcgttcatcttcgccggcacctgatccagcggtgtgtccagcacctggcactccagtacctcgcacccgctggagaagcccaccgacaggggcagagggatggagacaaaggcgtggggattgaagccctcggtgtgcttgatggcgatccccgcccggaggaaggagcgctggaaggtgcgcatcagatccagatgggagataaacttggcggtgtccgccttgctgaacgctaatctatgcttcggcatcgcatttccctcccggatagagcttgtccgccccgcagccggtacactgtacccggcagtcgggggtgatcaccgcctgataggcccgctcccgctcccgccacaggaagggcgtggtcacgccggtggaggtgaccgaccagggcagcacctcgtccttttcccgcacccggttggcatagaaggcggggtccaggccgcaggcgtcaaaggccgccatccagcggtcaaagtcaaaatactcgctccaggcgtcgaacttggcgccctggcgccaggcctcctcaatcacgtcggccacccggcggtccccccgtgagaacactgcctccaggaaactggtgtccggatcgtgccagttgtagcggatggaacgaccccgcatgttgtcccgcagtagcttgacccgccgccggtactcctccatgctcacctgggcctcccactggaaggcggtgtggggcttgggtacaaagcaggcggtggacacggtgatggtcaccccccgcttggggttgggggtgcactccttccacgccttgtataccttctcggccagctcggcgatgcccagcacatcctcgtcggtctcggtgggcaggcccagcatgaaatagagcttcacgctgctccacccgccggagaaggcggtgcggcaggagcggaggatctcctcctccgtcacattcttgttgatggcgtcccgcaggcgctgggtgcccgcctccggggcaaaggtcagccccgacttgcgcacatgctgcacccgctccatcaggcccagggagaagttgtccgcccgcagggagggcagggacagggagaccttgttgggctcgcaccactccagcaggccgtcgcacagcccctccaatgcccggtagtcgctggtggacaggctggagagggtcatctcctggtagccggagtcccggcacgcctcgatgccctgctggaccagccgctggggattgcgggggcgcaccggccggtaggcgtagcccgcctgacagaagcggcagccccggatgcagccgcggaacacctccagcatcacccggtcgtggacgatctcggtggagggtacaatggtcttaaccgggaaatagctcttgtcaaagtcctggacgatgcgcttggtcaccctggccggagccccctccagcggggtgacggcggccaccgtgccgtcgccgtgatagctcacctcgtaaagagagggcacatagacgccaggaatccgggccgcggcggtgaggaactcctccttaccccagccctcctcccgggcctggcggtagagctggataatctccacactcacgtcctccccttcccccaggacgaacagatccacaaagggggccaggggctctggattaaaggcgcaggttccccccgccaccacgatgggagacagctctgtccgctccccgctgcgcaggggaaggccagccagatccagcatgttgagcacattggtataggccatctcatagcccagggagaagccaatcaggtcgaaatcggcgatggaatcgccgctctccaggccgtacaggggaatcccctcccggcgcatctcctcctccatgtcgccccagggggcgaacacgcgctcacaccacaccccatccatctcgttcattagcccgtaaaggatacgcacgcccagattggacatgccgatctcataggtgtccgggaagcagagcgcgtagcgcacatccaccgcgcgccggtccttgaccactgcgttatactcccctcccgtataccgggcgggcttctgaacccgtgggaggatgtgttccaaagtacgattcatgccgaaccctctccatgtatctcgaaatcaatagaaaatgcagtaaattgtattatactatgtcttttcccgccttgcaacccccattcaaaaggaattgcattccatctttccatctacccggccagaagggcagcgcataggcacaggagaaccaatgcagccccgttggccgcagtgaacagcagcagatagcgccccggcctggcccccggcgtacgcaggtagaccttaagcgagatgaggctggccagcgaggcaatgggggtccccaacccgcccaggttggagcccaccagaaggccgcgccagtccgctgtaaatccggacaggagcactgctgccggaacgttgctgatgatctggctggtcaggccggtggtcagcgccgtgtggccttccatcaaggaggccagggcggcatgtaccgggccgcaggccccgatgtttccggcaaacaggaagaagcagaaaaaggtagcaagcaggccatagtccaccctgcgaaacaatccccggtcaaagagcagcagaccgcccgccaccacggccaacagcgccggatagggcagcacccggaataccgacagcaggcagagcacaaacaggcctgccatcagccccagacggcccggcctccgaagctccgcctgttcctgaaaccggacctgaattccctcatcccggacacacaggagggatgcggccgtcagcgcagccaggctgaccagggtcagcggaagcatggtcccaaaaaactgttccgccgtcaattcgtagtcggcataaagatagagattctgcggattacccaccggggtagccatgctcccaaggttggcggccatggtctggagcaccacaaggggggccaggtattccgtccgtccgatcagccccagcaccagaaccgcaaatggaacaaaggtgatgagcgccacatcgttggtcaccaccatggacacaaagaaaggcagcagcactagggcaaggctgaccaggcgcatccgccgctcccccgccagcaaccgctgggccagcactgcaaaaacaccgcactcctgcagtcccgccaccaccgccatcaggcagaacagaagggtgagtacccgccagtcaatatagttcagataggccggcgagggcggattgagaagcgtggaagctgccgcgcaaaccgccgcgatacagagtaccggctccttccgcagcagggccagccacctccccttcttctcctgaaccatccattcatccccttccaagtgcaaagaaaaagccaccccggcgggtggcctttctctcatgttcgacagccgaatgccatacattagtttactcgcttcccgctctgtggtcaagagcaaagcggcccgccgccccgctctttcacgagtgccggaagtcctccaccacgtcggccagatgtaccggtgacaatcccgcgctgttgcagcattcggccagccggtttacctcctggaagtccgtggatatccgtcccacgcaaatgccattcgtcccccgaattccgtacatctgcgggtgggaggccacatccaggaatacacaatacgtcttgtggttgtttctcatgtaagctctctcctcattcctaatacttttcggtgataaacgactgaattcgaccaggttctctcctttgccgtggtatactaaccgttgcccctttcaaggtcagtgtttttcgaccatccccctatcttgtatttccttccgtgctaatccctatattatgtatttcgagaggaatgtcaatacaattcggttattttgaccggttcaccggatttttttaccacatccggttaactcatgttcgtacaggaggggtgttccatgtccatgaccgaaaaactggcctacatcaagaagctgcgccacctgaccacggaggagatcgcacagcagtcaggcgttccgctggggactctgaacaaaatcttttccggtcaaaccaaaaatccagccgtcgggcctgtggacaagatcactcaggtcctgcgcattcccatacactaccttttagatgacgagcttccgattgaataccatgtcagcacctccacggacgatgggattttactgctctcctcagaggagattcaatttctcatgaaataccgggatctggagcctcacagcaagcgggcggtggataccatgaccgaacttctcaatatgccgcctggccggttggcaggaaatctgccggtcaagcggaccttttgctatgtaaccgctcctcccggggactccaacccattgggtgactccttttttctgcggcctgtactgatccccgagacagatgccgccgcccgtgaggcagactttgccgttctgctcaccaacggcagtatggagccgctctactccgccggaaccattctgctctgcaaaagggagcatgcctcccgccaggaatatggcctgtttcttctcaatcaggaggcgttcattcgccgcctgtactataaacggggcatcaccaaactggtcgcccctaatctgaacttcaaagacattatcatccatgagaacgactctctgaagtgtatcggtactatcactggcatcgcacacggatgccggtgggaatagccgggtccacagcccgattcgggctgtggacccgttctgtttacgcccattttctgagcccgtctctcaaaatttacattttaactcttgacactttcgctgcgtcggctactatatggaaggaggaagctatggactttacataaggggatgtcgtgcgatgaataagaaaaagtggatcaaacgcctgctgatcaccttggccgttctgctctgcggctttgccatttttgaaatcatcgtccatgtgctgatggactctgagatgagcagccgggacgattggaacatccagttgggagagcgtatgtataccagtgaggagcggggcgtttccctctactccgccccctgcgaggccagcattcccgtctcccggatggtgccggatgagtatgaggaggacggcttcacctactacgacgagtcggttcagcaccggctggggcaggagctgatggaactggtacagcaacaggggaacgccgccatcgacgcgccgctggccctccttaatccttttggaaccgggagcaacgggctcctcctcgccttccagacggaccggaaaagcgaaatccgctataccatccacaccaccagcgcagaattgcctgactataccgcaacagcgcagggcttgggggacaagcagttcagcaggaagcactgctttctgctggtgggtctcgtcccgggcgagacccaggaggtgacactggaggccataggcgagtggggcaaggtacaggagcgcgccaccttcaccattgagatgcccccctccagctccggctatgacagccggcttacatacaccgacggggacagcgccgccgcactgagcgacggcctcttctacgccaccggactgggcgattattacggctacaccttcttctttgataactccggtgtgctgcgctatgagatggtactggagggcttccactccgaccgtttcctctacaccgacatgggactctacacctgcgtcagcagccgaaaaatcgcgctgttgacccccattggtcaggctatccgcatctatgacctgggccagtatgagctgcaccacgacatcaactgggggccggacggcaccattctggccctggtcaacgacacggaacaagacaccgtgatggatgtggttgtcgagttggaccccgaaaccggcgctgttaccgagctcgtggatttctccacgctgatggacggctattacggcgccatgacccatcccgttcccctcaccggctcctccttctggcaggccggcgaggacgactggctccacctcaactccgttcaatacaggcaggcggacgacagcatcctggtcagctcccgggagacctccaccattgtgcaggtatccggcgtccacagcacaccaaccctcaccgccctgatcggcgatcccgcgttctgggcggggacggagtatgagtcgctctcctatcagccccaaggggattttgtcccccagtacggccagcatgacgtggagctggttgaggatgacagcctgccggagggacaataccttctgcgcatgtacgacaacaactattggagtctgagcacccgggacgactacgagcctgagctgcccgacagtgttggaaccagcctcacaggtgggtctggaatccactcctatgtgacctattatctggtggactccaacgccaaaaccttctctctggccaagcagtttcccgtcacctattccagcatcgtttcaaacgcccagtcctttgacggcaattatgtggtcaacagcggtgtggcccatgaattcggcgagtatgacagcgaaggcaacctgatccgcgccttctcctacgactgtatgatgaatggctaccgtgtcatgaagggtgacttcgagggcttttggttccgggaggcgtcataaacaggcaacagacaagggagcgccgcagattattctgcggcgctccccgttttttgctcatccatcatctggtgcaggcaggccagcgcgtcggacaggccgccgatttcgtcaatcagtcccaggcgcaccgcctcctccccgtagatcacgctgccaacatccgcggccagctccccggtttggagcatcagccgggtgaagtcctcccgttttacacggctgttccgggtgacaaactgaataatccgctcctggatgcgcgcaaagtagttgaaggtctgggataccgcgatcaccaggccgttcagccgcaccgggtggatggtcatggccgccgacggggcgataaaggacctcttggccgacaccgccagaggcacgccgatggagtgcccgccccccagcaccagggagacggtgggcttggacatggaggcgatcagctcggcgatacccaggcccgcctcgatgtcgccccccacggtgttgagcagcaccagcaggccgtccacctcgtcgctctcctcaatggccgccagcaggggcatgacgtgctcatatttggtggtcttggccgaggagggcagaacctggtggccctcgatctgtcctacaatggtcagggtgtggatggtcccccgctccgtccggatggtggaggagcccatatccacgatctgctgctggcgctggtcgccgccctcctcgcttccggtctccgcagtctgcttcgtctcatccatgcccataccctcccaaaatgtcgtttggattcagtatgagccggcgggggcaattttatgcaaccgccgcagcgcgccttactccggaagccggtccagccagcaccccggcccagcggtgccgtcctggttcatcggcagatagcgctggccgatcgcgatacctgttacctccctcggatcgatggctctcgggaaataccatacgatatcctcaccccagcggtccttgtttccaggagcgtaataggtcagggtgtcctcctccgtgaaaaagactgtcctgcggtcgcagtttccgttatatgggatcaccatggtactgccgtccgtcaaatagacggtaagtggaaacccattgcaggtggggtagtccgaatcttcaaattgagcgtgtgtctttaggctggtagccgtcagggtgatctcccgtatcacctgcctgtttagcttctcctccagcgcaatcgtgcactcctgcagcagctccagcgggaagctcagggtccactccccctcaatgggctgccccatggtcagctcgccccatatgtggtcaatgcggaactggccgaaatgctccgccgtcagcgtacggaaccggatatcgtagtacgatattccttcccactggaatgtggtgtggatctccccaatggcgcccacctcccactccacctgcggcatacccgtctgcaggtagccgtattccccgccgacgccgtccgccagccggagttgaatgtgaaaggccccgtcctggtcaaaccccatggaggacaggctgcacagctccgtgcccaattccgccggcgtctggccggggaccagcactgttctggtttcctcccgtctctctcccgatatgtacttctctgtcgctacggtcagggtatccagccgctctccagtcagaagttcccacggaagaggtgcgaaaaatggctccactgcggggagaacgcgggagaattctactgtatacacatcccccgtctgcatctggcacggagcgatatcgtccagcgcgagggcaaacagtaccgtatcggcttccgcgtcgtaggcaatacagggatcgcggtaggattccagggcagcactttcgtgcagccgctcccccaccagatcctccgcctccaggtatgcagtgcccccattcttatccgccaaaacccgcactacccgcagctcgatgccctggtccgtagccgacaccccctctacctcctgagcgtagggttcaaagctgccgaggaattggatcagcgtttcccgtagagggggtgagactgcgacggcggtcacggccagagcggcgcagatagccgccgccataaggccggtacgcagcggacggcggcggttttctctctccgtcatgcgccccgccgcggccaaaattgcctcccaccgctccgtactcaggtgaagctccgagagcgccgtctccagctcggcgtgcatgctctgcttattcctgctcatagtaccaccccttcagacgttccttcagcagtccccgggcccgtgagagccgtaccgtcacggtggagaccggaacgtgcagcctctgggcgatctcccaggccttccactcctggtaatagtaaaggatgatcacttcccggtattttggcgggagggcctgtatggcccgtaccagggtgtcgtccggcggttccggtccttccatgcgcaggctgtccaggctctcctgcggcgcccgcagaagcctccacgggctcctgagctggcgcttacacacattgatagcgatacgcaccagccacgtctccacggcacagtctcctcgaaaccccggccaagccctcagcgcacgcagaaaggtgtcctgcaccgcgtcctccgcctggctccggtctcccagatagagcgtacacagccgtagcaggtggtcgccatgctcctccagcagaccggccagatccatggtctctccgcactctgagatgaaaggcttctccacatcccgtcccccctttcacttcctgtctattagaccatgttcctcccccctttgctacaaaaacttttcctactcttcatccgtactagaaccggacggcaacaggctggcatgcaggattgcgagcagttgcgccgtacacggcttttgggagagttcccggcgggccagagtctccaaaagcggccggtttgaattccaaatcacacggcccacggtacggatatcccgctccactgccttccagttcgttccgtattgctttgctacatccgggtagagccattttgtcaccagcagcagacgttccggctcctctgcacaaagctggagcgcccgtaccagataagaaaatccggtatagttggccgttgcgcccagccgatacagcagatgatatgcgtcctccgaatgaattttcatactgtccctcccccatcaggcgtgtcgcgcttcctcaccatcgcagagcgcccgcgattcttcccgagatttctgtcctccttcggagagctgcagaagtgtggagagctccattcccagtatggccgccacccgatccagggcgcgaagcgtagggtttgcacggccgtgctcgatcctgcgcagataagtcacgctcatctccgcctccaacgccagtttttcctgtgtcagcccctttctttcgcgcattacaacaacagttctaccgatttctataaaattcaacataaaatccctcctttttccatagcataggagagattactattttgggccagattctatagtatcggttgcttcatttttacttattttttacggctcataccccagaggtataaagcaagcgcacctgcggccatcccgcaggtgcgcttgcttcctatgcaaatttacttctcgtagaacgccttgattcccttgtaggtcatataacagtccagcttacccactgtctcaaagggggcgtgcatgctcagcacgggcacacccgcgtcgatggtgtcgatgtcgcgctcggccatatagcaggccacggtgccgccgccgccggcgtccaccttgcccagctcggccatctgccacaccacgccggcctcgtccagcaccctgcggatataggccaccacctcggcagaggcgtcggaggcgcccgacttaccgcgggaaccggtgtacttgcacaggccgatgccgtagttcacccgggcgctgttgcgcttctcatagacctcggcgaagttggggtcgtaggccgcggtcacgtcagtggacaggcagaaggacttctcgtagcaggccttcagcggcacccgctgggcgtcgcacaggtcgctgacaaaggtatcaaaggctgcggatttcatgccgctgacgccggccgagccgatctcctccttgtccgccagcatacagacggcggtcttgccgggggtgcccagggccagaagggccgccagacaggcaaagccgcacacccggtcgtcgtggccgtaggcaccgatcagggagcggtcgaagccgatgtcggcagccttgaaagcgggcaccacctccagctcggcggagatgaaatcctcctccacgatgtggtacttctggttcaggtagtccatgacggccagcttcacccggtcggagccctcgtcgtccttaaaggggcggctgccgatgagcaggttcaggctttcgccggggatggcctcgcccaggggcttcttggactgctccacgcccaggtggggcagcaaatcgtcaatggtgaactgggggtcctccggcgcgccgccgatagacacggccacggtagagccgtccttcagggccaccacgccgcggagctccagggggatagtcacccactggtacttgcggataccgccgtaatagtgggtcttgaaaaaggccagctccgcgtcctcatagagagggttgggcttgagatccagccggggggagtcgatgtgggccgcgccgatgttgacgccctcgctgaggggcctggtacccaccacggccagcatcaaggccttgccccggttgatccggtacagcttgtcgccaggattgaccgccatgccgcgggtgaagggcttgaagcccttagcctccgccaggcgcaccgcctcggttacgcactcccgctccgtcttgcctgcgtccaaaaacttcttgtagccctcacaataggacttcatatccgcctcgtcctgggcgctcaggcggtcgtagccgttcttgggctggtagagcagcgcctcgcgccgcagctctcccgccgtcttctgcttctcttccatttgaattcctccttcgtctagttccgattgctcagtatctgctcaaacagttgcttggcacgggcctgaaaggcctccggcgtgtcgtccgcccggttttccaggagataatcgcagtgggtgcggaaaaagccgtccccctgctgggcctccacccgcttccgggcgtagtcctccgaaatcccctcccgggccatgatccgccggatgcgcagttccctgggggccagtatgcccactatcgcgccacaggtctcccccaggccgctctcaatgagggcgatggcgtcgatggccacggcgctccgcccctgctcctccgccccggcggcctgccggtcgatctcggccaggatgaagcggtgggtgatggcgttcagctcggccagggccgccggatcgccgaataccaccccgcccagggccttgcggttgacacggccctccccgtccagaatggaagggccaaaccgggcggtcagctccgcccgcagggtggcgctggactccagcagggcgtggtacaccgcatccgcgtcgatgatatgggcgtccagctccgccagggcctggagcgcggtggtcttccccgccccggtggggccggtgatgccgatgcgtttcatggatggcttcgcctccgtggttcagtatagcatatctcgttccgggtttgttatgtatttgtaaatttccaccgcaggagaggcttcactccgcccgcacgatgtggaagccggcggccttgttcagccggttggataccgccaggccgataccggcggcggcgggacactgggcccagatgtgggacacgccggtgccgtcgaaccagcgcagggcctcaaagacccggcgggcctgctccggcacgtcggtgctgggccccagctgctccagcgggtggccggcaaacagcccggcgtattcgtcgaagcagatcaccccgtcgccgggggccatgtgggcctggatgtagcgggccgccgccgccggggccccctgcaccacggtcaccggggccttgggggcgtagtggcggtacttcatgccgggggcccggggctgctcccccgcctccatgagccgggtcaccgcaggatcaaccgccacctcacccagcgcgtcccggagctgttccagggtgacgccgccggggcgcagaagccgtgggggcattaccgtcagatccacgatggtggactccacccccaccgcgcagggtcccccgtccacgatgccgtcgatttttccgtccatatcctccagcatgtccgccatattggtggggcttggccggccggaggtgttgcccgacggggcggccaccggcacgtcggcggccgccagaatggcccggcaaaccgggtgggccggacagcgcatccccacggtgtccagcccggcggtcaccacgtcgggcaccacgcgtttccgccggagcaccatggtcagcggccccggccagaagcgctccgccagggcataagccgtgtccggaatgtccgcgcagtagcgctccagccagtccgccgaggggatgtgcagaatcagcgggttatcctggggccgccccttggccgcgaagatgcggcccacggcgtccgggttcaggccgttggcccccaggccgtacaccgtctctgtggggatgcccagcaggccgccccggcggagaatctccgccgcctccgccgtgtcccgcggctgtagtctttgtgtgtgcaatgtgctcaccttcccgatggttcagcttctcccgatggaactgccgatgtgcttttccttccgccactggggcgggggcccatcgtccgcccagtactcatctaagcgggtgatcctgtcctccgcgaaacggaaaaaagacaccgcatgaaaacgggcgctcctgtccttcggccacaccgctgcgaccgaaacacaaccgccctccgtccattccgcacgctccaccgcgccctcccagtcccctgggtactcacagttggcccgaatgtattcctccgccgtgaagcgctcgtccgtgcagtgccaatacacctctgcttccggcgcgaaccactcccgcagggctgcggcatcctgccgcgccacgtccgcccaaaagcgggacagacgctcccacagcgcggcatcttccctgctcaaaaacgaactccccttccatgccgaacccgggcactccgtcgtgcgcttccctccacgatggtcagcacgcccgcggccagcagggccgcgccagagacaatctgtaaaatgccgatggcttttttcataaaaataccctcccctgcttattcgtagatgcccaccggcgtcccggccagctcgatggtggtgtccggggcgaaccgggctttttgcagataacccttcacggtgagaataccgtacttggggttcaccttttcgtcctccagctccagctccagatagtccgcccctgagccggtcagccagccgtcgtcctccagcagctccgccaggtcggacttcaccatatccagggtcagcttctccggcagggcggtaaagtgaatgatcaattccacgctttcttactccttttctcagccttgtacgctgtttttcggccgtccccgccgcctcagccgtcctgctcccgggccctcagccgctccgcctggtcggcggtcaccagcgcgtcgataatctcgtccaggtcgccgtccatgacgctctccagccggtacagggtcagcccgatgcggtggtcggtcagccgcccctgggggaagttgtaggtgcggatgcgctcgttgcgcatgccggtgcccacctggctgcggcgctccgccgtcaccgcctcctcctgctcccgcaccttctcctcgtacaggcgggagcgcaggatctgcatggcccggtcccggttctggaactggctgcgctcctgctggcactccaccaccgtgccggtgggcttgtggatgagccgcacggcggaggaggtcttgttgatgtgctggccgcccgcgccggaggagcggaaaacctgcatctcgatgtccgccgggttgagctcgaagtccacctcgtccacctcgggcagcaccgccaccgtggcggtggaggtgtggatacgcccgcccgactcggtctcaggcacccgctgcacccggtggacgccgctctcgaatttcagacgggaccaggccccgtctccctcgattgtaaagcagatttccttcacgccgcccaactccgtctcgttgaccgagtccacctccacgcgccagcggcgggcgtcggcgtacatagagtacatgcggaacagggagtgggcgaacagggccgcctcctccccgcccactccggcgcggatctccacgatgacgttcttgtcgtcgttggggtcccggggcaggagcagcaccttgatctcctcctccagccgggccagctcctccctggcctgctggtactcctcctgggccagctctttcatgtccgggtcgcccatcagggcctcggcatcctccagatcctgccggcggcgctggtaggcccggtaggccatgaccactggctccagctcccgctgctccttgttgagtctggccaccagcgcgggatcttcataggtctccggcgcgctcagtcgggcctccacatcggcatagtggagatccagggcgcgcagcttttccatcatttccaagtcatatcacctgtcaaacaaaaaggactttaccagtgcaaagggttcccgaatatacatcttcagccgggacggcacatgggtgtagggggccgccagggtggacagctctcccgctccgccggaggcgcgctcccacagcatacgcgcccgggtgaggtggaagccgctggacaccagcaccacgccggcactcgtgtccgcccccttctcctccagcagcgccagggtataccggacgttctgccaggtgttgtgggactggtcctcctgccagatgcgttccggctccacgccgcgctccgtcaggtagtcgtacatggcctgcgcctcagtagtgggctcgtcggggccctgcccgccggagaccaccacttgaacatccgggtgctcctccaggtaatccagcgccttgtccagccgatcctggagcaggatcgacggcccccagggctttacctgacaccccaggatgaccatgagctgcggctcgccctgtatgtggtcataggccccgtacatcaccgcgccaaagagggcgccaaaggccagcacccccgccagcagcagggccagcacagccttctgccacaggggccgccgctttccctcgtaggggcggtagtagctcttccttctccggttcaccctcgggcctcctccagctcggccgccagcgtctcccacttcgtgtaaagcgcggcgatctcctcctccagggccttctgctcgtcatagaccttctgcagctccagatagttggaggccacctcctcggccttgagggtcagctcgtattgccgctcctccgccttggccaccgcccgctccgccgcggccacctgcttctccagctctttggtgccgccgggacggcggggcttttcctttttcggcttctccggttccgccttgacgaggaccgcggcctggagccgtttccgctcctgggcggcccggtactcctcaaaggtcccccggaaatcaatgatctgtccgttctccagcatccagatacgggtggcaaagcggttgatgaagtagcggtcgtgggagacaaagagcagattgccctcgtagctctccaccgcctcctcaatccactcccggctggccacgtccaagtggttggtgggctcgtccaggatcagcagattgatcttctcgtccatgagcatacacaggcgcaggcggctctgctccccgccggagagggcggacacgggcttgaacacgtcctccccccggaagttgaaggccgccagccgattgcgggccgtctgggtggagcagtcctggtcgtagatcatggtgtccaccagattgcgctccgggtgggagaagcggatgatctgaggcaggtaccccacctttacagtcggtcccatgcgtagctttccggagtccggctcctcttcccccagcaaaatcttcagcagggtggacttgccggtgccgttgtcgcccagcagggcgatgcgctcgccgccgatgacctccaggttcacgtggtcaaagagagtgcgcccgtcaaaggacttcttcagctccttgatggtgagcacctcgtccccccggaactcgctctccccgaattttatgtctaagcgccgctccttggtgggcttgtcggtggtgcggatgcgctccatgcgcttttcgatggaaaaggcccgcttgtgcagcttgtcgttgcccatgaacgcccacaggtgcagcttgtccgccgcctcttggagctgctcaagcttggcctgctccttctcgtactgcttgagcttctcctcgtagcgccgctccttctcctccacataaaagctgtagttgcccgcgtaaaactccgccttgccatcgtggatctcgatgacccggcgtaccacccggtccaggaaccagcggtcgtgggagatggccagcacggtgcccttgtaacggtccagatactcctccagccattcggtggcccggagatccaggtggttggtgggctcgtccagcaggaggatgtcggtatcctccagaatcaggcgggccaggttgacccgggtcttctccccgccggagagggaggaaaaaagctgcccccgcatgtcctgggaaatctccaggccattgcataccttatttagctccgtctgggtatcgtagccgccccccgcctcaaaagcggcggtgagggcgtcgtaccgcctgagcagggcggggtctgtgtcggcgcccatctgctcggcgaggcgggtcatctcggcctccatggcgtgaagccggtcaaaggccgtctgaagcacatcctccacggtgtaggcgggcgggtaaaccgggatctgtgagatgaggcccacccctttgccgggggccacatgcacttcgccctcatcccagtccagctccccagtgaggattttgaacagggtggtcttgccggcgccgttcttgcccagcaggcccacccgctccccctggtctacctgaaaggtcaggccgtccagtatctttttgcctacctcgaactccttggacaggttcgagacggagatatcaatcatttgtttactcctgttgtccgttgtgatatagtgaaagacgaaatcaaggaatggaggttttccctatggacgccatccgatgggaaggaaataccctttacctgctcgaccagaccaagctccccgtgaccgaagtgtggctcccctataccgattaccggccagtggccgatgccatccgcaccatggtggtgcggggcgcccccgccatcggtgtggccgccgcctatgcctactgcctggccgccctggccggtgaggggctggacgaggccaaggagacactggccgccagccggcccacagcggtcaacctgttctgggccctggagcgcatggaacgcaaggcaaaggagtgcggcggcgcggcagaaccgctgatcgccgaggccaaggccatccacgccgaggacgtggccatgtgccgggccatgggggcccacggggcggcggtggtgccggagcacgcccgcatcctcacccactgcaacgccggggccctggccaccggcggctacggtacggcactgggtgtcatccgcgcggcccatgaagctggtaaagtaaatatggtttactgtgatgagacccgaccgctcctccagggagcccgcctgacggcctacgagctggtatccgaccacatccccgccaccctgatcgcggacaacatggccgccagcctgatggccaaggggaagattgacctggctgtagtggggtgtgaccgcatggccgccaacggcgactttgccaacaagatcggaacctactccgtggcggtcaacgcccattaccacggcattcctttttatgtggccctcccctgctccaccatcgacctgtctctggccgacgggagcggcatccccatcgaggagcgggacagggacgaggtgcgcaccctgtacggcacccgcaccgccccggagtcggtggaggtctgcaaccccgctttcgacgtgaccccccacagtctggtcaccggcatcatcaccgagaagggggtcatctacccgccctttcaggagaatctgcaaaagctgtttggataaagacgggccgatgggaacaccggcccctgctggccgccgggcggacacccggcggcccttttacgcctcccctgtgatggtgagcaggtaatccaccagctcctccagcgccatgccgcgggaggccttgaccagaatggtggcatggggccgcaccacgccgtccagcaccggcctggcctccgcctttgtggggcagtaatagcactccggcacgccggcggcctgggccgcgtcatggatgtgccttgccagctcgcccaccgccaccaggcagtcgatgcccgccttgcccaggtagtcgcccacgccggcgtggagggcgggggccaggggccccagctcgaacatgtcgcccagtacggccaccttgtacgctccccgggcactggagagcacctccaccgccgcccgcatggactgggggttggcgttgtaggtgtcgtttaggatggtgatgtcatcgccccggtggagcaggttcatacgcattttggtgggggcaaagtggagcacgccgtcggcaatctgcgtctgcgtcaggccaaagtgctcccccaccgccgccgccatcagcgtggggtagatcatgtggtcgcccagggcggggatctccaccggaaaagagttgtggggtgtttttacttcacaggtcatatggctcttgccgtcgctgaccagcctctccgcccggtagtccagcccctctccggcgcccacgcgggtgaacgcataggggagcttccccggcagggtgttcagcaggggatcgtccccattgatgaccacgaaggcgccggacttgacatggtggaagatctcgctcttggcctccaggatcttctcccgggagccgaagtgctcgatgtgggagtcgccgatgttggtcatcagcaccacatcgggctccaccagggcagagaggtagtcgatctccccggcatggttcatgcccagctccagcacggcaatttcgtgctccccgctgaggcgcagcagggtcatgggcacgccgatctcgttgttcaggttgccctcggtcttgagcacccggtacttctcccccagcaccgccgccaccatgtccttggtggtggtcttacccaccgagcccgtcagggccaccacaggtatggggaactttttcttgtaatacttggccagatcccgcagggcccgctgggtggagtccaccttgatatagaacttgcccggcagatagctctcccgctcccgctgggtaaagcagcccgcagcgcccccctccagggcggcgttgatgtaggcgtggccgtcgaatcgctcccccaccaggggcacaaacagggacccagcgtggatggtgcggctgtccgtctccacccgtcccaccatccggttgatatccccaaactctcccagcagcttaccgccgaccgcgtccatgatttcacgtatggtcatcggctccataatccgtttccgctccttatcttccctgttttcgggcctccagagaggcgtgcacaatgcgctggcacagctcgttgtagtcaatgcccgccgccgcggcctcctggggcagcaggctggtgggtgtcatgccgggcagggtgttgatctccaggaaccagggctccccgtcctccgtgaggatgaagtccgcgcgggagtacaccgacagccccagtgtctcgtacacccgcagggccgcggcccgcacacgcgcctcctcctccggagtaatctccgccgggcagacctccagagcggcgccgggctggtacttgttggcatagtcgtaaaagccctgcttggggatgatctcaatggagggcagggctttatcctccaggatgcccacctggatctcccggcccctgatgtactcctccagcaccgtgcgcccacccagggccagtccttcagtgagggaccggcgcagctcctccgccgtgtgggcgatggatacaccgatggaggagccgctggccaccggcttgaccaccaggggcaagcgggcagtctctaccagtcggtcgatgtccgcggcggtgtaggcgacggtcttccagccgggggtggacaccacgtcggccaccatccgcttggtcagatccttgtccatggcgatggcgctgcccagatagcccgcgccggtgtagggaattcccatcagatcaaaggcggcctgcacccgcccatcctcgccgcaggtgccgtggagggccaggaataccatgtcggccatccggcacaactccagcaccccggggccgaacatgctggggctgtcccccttccggccgcgccgcacctgatccagatccggagcctcgcggctgattttcttgtaggcctcggacacaggcgcgtcaaaaaatgcctcgtccgccccgcccgtctccaggccgaaatataagtcgatcaggcccgcccggtggcccagcgcccgcagcgcctcggtcaccatggttccagtggagagggacacattccgctccggagacagtccccctgccagcacaacaattttcatagcacacctcgttcgagagtttgatacaatatgatacgcactagtggtatattatagcacggttccggcctattctcaaccttctttcgaaccttccccgtccaattcttgcaaaagcacctcctctgtggtagagtagagcggagattggggggtgcgctgtgaaaatcgcgtggtatgagccgctgtttttcctcttctttggggcgtttcatctgcaccgtgtctgggggctggcggaccgggagagctacgccgccttctggctgggggttctgacacaaaagggtcccctctacttcggcctgatgggccttctggccgtgctgtgcctggcgggcgtcgccaccttctttcggaattggggccgcaatccctggtggcggtggatctacctcttcggcggcagctatgtcctgttcgatctccttgccattgccgccggcctgtccttttggcactccctgctggcctggatgtttgatgtgacctccccctgctggaattttctctggggctttttcgtcctgctgggcggcgcctcagccgccctgggtctctcgcttctggtgcgccgcacataggcaatgggccggttccctacggaaccggcccattctctctgttcagagttcagaaccagccgccatcccggctgtcctgcaactccagcgcgccgcacagcagctcggccgcctcgcccctggtaagtggggcactcaggcctccgtccagcgacagtacgccgcaggtggcaagattggcggcagactgggccgcccaggtgggaatcccctcctccgccagcgtatcggcggacacgtcagtcacctgaagggcccggtccaggagcaccgccgcctctgccgcggtgatgggctcctccgcctggaacactacctgcccatcgctggagcggctgccctgcaccagtcccgccttcagcgcggaggagacgtagggcttggcccaggtgggaatcgacacatcgtcggcaaagccggtgcgctctacgtcctccagggcttccataccggcggcgttcatggccatagccacaaattccccgcgggtcacggcagcgtcgggctggaagaaataggccccacccatgcactcgcccacgaagatcccctcctctgccagccggatggcagccttatgggccgggtcgccgtccatgtcggcgtaggtgaccttggtattcggcttttcaatcttgatcttaacggtagcggggtcggaggagttgcccaccgcatccaccgccacataggtgaaggagtccttgccagtcttgttttcatagggagtgtagacaaattcgctgctgccgtcctccggcatggtcaccgccccgcgggcgggcttgttgaggatatgatacgtgagcagatccccctcggggtctacggcggaaaactgggccgtcaccgccacatttttgtaggtggtgagctccaggttttccgccaccggcgcgccgtttgcctcggccagcaggtagagttcaacggtgacggcatcgccgctccgcccgtcggaaaagaccggggtgaactggaactgagcctccaggccggccggtgcggccagaggggtgaagcgcagtccgtccaccgcctccatagcaatcacgtcgcccacctggatgccctgagcgcccagggtgagacagccgaccgcggcatccggcagagtggtgatcacaatgctgtccagcttgccggagccttccacaacgaagtcctcctcagaaaaggagatgggttccgccgccgggccatttttggtcatggccgccacgcttgggaccgcctcatctttttggaagaaaaaggcagatgcaggccagccagcggagtacaggaccgccgccagcactgccagcggcagaacgcggcgcagaaggacgcggtgtttcaagacaattacctccttgtttggaaatcatccgtagtctttgccaaatcaaggagaatatacggcggaggccatccaaatcggacagccccgtccactggttcaaatacggctccgatcccgcagccagctcggaagggagcgcattttgatactggagataatgcccatggccgcaaacatggtgacgatggaggtgccgccatagctgatgaacggcagtgtcagccccacaacggggaacacatagagacacattcccacgttgactccaacctgggccaacagcatccctgcgtaccccatggcgatgaaagcgctttgaggcgagcaggcccgccgcgccacccagatgcagcgggcaatgatcgctcccagcaggaacagcagaacaatacacccgatcaggccgaactcctctccgcagaccgcaaagatctcgtcggtgtgccgggcgggcagggcagactcagagaggctctgggtctgaatccccttgagataccccatgccgaacagccccccgctgccgatagccaggatgctgcgggtctgctgaaagccctgtccctgagtctgttcgctgatggtctccgtattgcccataatatgatcgatgaccacggtgatacgccgggcgaagtacttgtcgctgatgtggggccaaatgagcacggcccctatgacacaaaccacaatggccagcaggaaccaccgttttttcaccccgcccgcccaagccatgatgacaaagataaaggcataggtcagcgccataccgaaatcgccggaggtcgccacaatcaacccgatcatgaccagggtgtggcccgccaactggaatacggaggaggggcggctgagtccccgctcccgctgccggttcatctgccaggccagcagcagtacgaaggtcagcttggccagctccgccggctgcagattgaccggaaagccgggaatactcagccaactgttgttgcctgtctcatccgcgccgatccccagtggggtcaggagcagcaaattgatgaacagtccaaacaaaaagagccatttccaggatttttccgtaaacagctcaatatcaaccgaggacatggcgatatagacgaacacccccagaacgatacccaccgcctggatcagcatgcagcgcaaccccgccgagtggttcatataacgggtggcgctgtaaatcagcaccattccgaagccgctggccagcaggcagagcgtcagcaacagccggtcgccccggtgtataaattcgcggatcgaatcggtcagccagttcaaccacatccctcccttccaaaaccgtgcttaaaatcaatttagtttaccatcttttttgcgtttggtaaacgggtgtggtataatatttaagcgaattttcacattcgaggtgttatatggaatatatatccaactccccaacagagaccgaggcgctgggcgaggcgctggccgcccggctgacagcggggacggtggtcgcctttaccggagatctcggggcgggaaagaccgctttcacacggggactggcccggggattgggcgttcccgaccgggtcaccagccccacctttaccattgtcaacgaatatggggggggccgtctgcccttgttccactttgacatgtatcggctgggctcctccgacgagctgttcgacatcgggtgggaagactatctggcccggggcggcgtgtgcgccgtggagtggagcgagattgtcagcgacgcgctggaggacggcgtgctccgggtggacatacggcggggagccggtgaaggagagcgcatcattaccatcacgggagggacggacgcatgaaaatattggccctggagtcctccgccaccgcctgctcggtggcgctgtgtgaggatgaggctctgattgcccagtccttccagaacaatggcctgacccactcccgcaccctcatgcccatggccgtatccctgctggacaactgcggaaccgccttggacgcggtggagctcatcgccgtggcggccgggcccggctccttcaccggcctgcgcatcggcgtggccgccgccaaggggctggcctggccggggaacaagccctgcgcggcctgctctaccctggagtccatggcctggtgtctggcccacctggacggggagatctgtgcagtcatggatgcccgccggaaccaggtctacaacgcccgcttccgcgcggcaggcggccgcttggagcgcctgtgccccgaccgggccgtgggcctggacgccctggccgacgagctaaaaaagagcgggaatccgcaatttctggttggagacggcgcacttttatgctatactaccctcaaggaactggggttggacatccggctggcgcctccccacctgcggcaccagagtgcctggggggttgcccggtgtgcactggagctgaccagagcgggcaggctgaccgacgcggccggactgacgcccaattaccaccggctctcccaagcggaacgggagcggctggaaaaagaacaacacaaaggggaatcgtgccatggacatggaaaaagtacacattttggaccaccctctgctgcagcacaagctgtccatcctgcgggatgagaacaccggagttaaggacttccgtgaggtggtctcagagatcgccacgctgatgtgctatgaggccacccgcgacctgcccctggaggaggtggagatcaaaactcccatcaccaccgccaaattcaaaaccatcgcaggcaaaaagctggccattgtccccgttctgcgggccggcctgggtatggtggacggcatcctgacccttattccctccgccaaggtgggccatatcggcctgtaccgggaccccgacaccctggagccggtggagtactactgcaagatgcccaacgacatcgccgagcgggaggtcatcattctggaccccatgctggcaaccggcggctctgcctctgcggccatccagtttatcaaaaattatgaggtcaaaaatatcaagcttatgaacatcatcgccgctcccgagggcattcagcgggtccaccacgaccaccctgatgtggatatctactgtgccgctctggacgagaagctcaacgaccatggctacatcgtccccggcctgggcgacgccggtgaccgtatcttcggcaccaagtaaaaaatccataagcatgcggcgcgggcagatgcccgcgccgctccagtatcaagagggccaccccatcggggcggccctcttcagcctgtctgtttacttgctgtgcttctcctgaaggtactggtgcatggactcggcggccttcttgccggcgcccatggccaggatgacggtggccgcgccggtgacggcgtcgccgccggcatagacgccggggcggctggtggccatggtctcctcgtccacctggaggcagcccttccggttggtctccaggccgggggtggtggagcggatcagggggttggggctggtgcccaggctcatgaccacggtgtccacctccagggtgaagttggagccctccaccaccttgggggcgcggcgtccgctctcgtcgggggcggtgaggcgcatcttcacgcactccaggccgcccacccggcctgtgccgtcgtccagcaccttcaccgggttggtgaggagcatgaactcgatgccctcctccttggcgtggtggacctcctccttccgggcgggcatctcctcctcatcccggcggtagagcacgtagacgtgctcggcccccatgcgcttggcgcagcgggcggcgtccatggccacgttgccgccgccgatgatggcggcggagccggagattttcaggggggtgtcgtacccctcccggtaggccttcatcaggttgatgcgggtcaggtactcgttggcggagtacacccccgccagggtctcgccctcgatgcccataaacatgggcaggcccgcgccggaaccgatgaacacggcctcatagccctcctcaaacatttcgtcaatgtcgaaggtcttgccgatgaccatatcggtctccagatccacgcccagggcggtgagcttgtccacctcgttctgcacgatggccttgggcaggcggaactcggggatgccgtacaccagcacgccgccggcggtgtggaaggcctcgaagatggtaacctcgtagccgtgcttggccagatcgctggcgcaggtcaggctggcggggccggagcccaccaccgccaccttgatgccattggtctggggcttctgaggcatggcgttgacattctcccggtaccaatcggccacaaagcgctccagccggccgatggccaccggctcgcccttgatggcccggacgcaccgggcctcacactggctctcctgagggcagacacggccgctgacgctgggcagggcgttggtgtcggagataatatcataagcggcctggaagtcgccctcggccactttggcgataaactcggggatgcggatgttgaccgggcagccgcccacgcagggcttgtgcttgcagttgaggcagcgggccgcctcttccatagccatctccttggtgtagcccagggagacctcctggaagttgtggttgcggacattgggctcctgttccggcatgggaaccttcttcaaactcatattcggcatggtattcggctcccttcctcagtgatccatcagctcatgggccaactggtccatgcggcaggcgtggcgctccttctcttcggcctcctgggcgcggtagacggagttgcggttcatcagctcgtcaaagtccacctcatggccatcaaagtcggggccgtccacgcaggcgaacttcatcttgccgcccacggtgacgcggcagccgccgcacatgccggtaccgtcgatcatgatgggattcaggctgacgatggtcttgatgccatagggctcggtggtcttggagacaaacttcatcatggggatagggccgatggcgatgacggcgtcatagtggatgccggaatcaatcagctccttgagcttcacggtaacaaagccctgctcgccgtaactgccgtcatcggtcataatgtagaggtggtcgcaggcggacttgaactcgtcctccagaatcacaatgtccttagagcggaagccggcgatcacgtccacctccagcccctcagcatggcaggtcttggcctggggataggcgatggcgcaacccacgcctccgcccaccacgcagacacgctttgccccctcgggcagctctgtgggcagccccagcggaccgacaaagtcccggatggagtcgccttcgttcagctcggccagcagctcggtggtcagccccaccttctggaaaataatagtgaccgtccccttctcgcggtcatagtccgcgatggtcagcggaatgcgctcgccctgctcgtccaggcgcaggatgatgaactgccccgccttcgccttcttcgcgatcagaggcgcctccacctccagcagggtaacgctggggttgagtacttttttatgtacgatttttaccatgtgacttcaacctcttcttctctacggtctgatctaacttactaaatggaaagtgacgccatacgtcaaaataagactggccggtttagaaattccttactgccgcaaggctttccggttcctcagtcttaacgcgataacgatatcagttttcttttactttgtcaagacagaataaacgccgccgcataatttatacggcagcgttcagcctgttacctccgctcaaccggccagcggagggtgatggcaaacatatccccctccagagcggcctccgcccggcagtccatctgcccggccagcgctttgacaatggccaggcccaagccggtgttccggccggtgcgcatcttgtcggaggtaaagaagcggtcgaacacgtggggcacgtcctccgcagtcagggcgtgggtttcgttggaaaaccggctgaccacctgcccgccctcctggtacagacggatttccatgcgcccctctccatgctccagagcgttgcggatcagattggtgaaaatccgcagcaccgccccggcgtccgcccacacctggggcagcccctcggccaactccacctccatgtcgaagcccctgtcggtgaaatcgttgtaaaaggccgccagcagaccggacagagaggcgtagaggtccaccttctcccgctggagcaggtactctcccccctctagccgtgagagatcataaaagctggtaatcaggctctggagcgtcctggcccgccccgcaatcaccgccaggtattcccgccgctccccctccgtcagtccggggtcctccagaagctggagatagcccaggatggaggtcaggggggtgcggaggtcgtgggagacattggcgatctgctggcgcagggcgcgctccctcgcctggtaagcggccctgtccgcctggcgcagctccagcaggcggttcacctcgtccagcagctcctccgccgcgctgttgggtacggccagccgtacgcgggcggtactccccgtatcctccagcgcccggagccggtacgcggcctcccgcagggagcgccgctgggcccacacccaaaaagccagccccgcacagagcagggccagcagtatacacacgatcagcacgcggaaacctcctccctagcgaacgtctctccggccaaacagaaacagccccagccccgtgctggccgccatccatcccaggccgatggcccagcaccagagctggtactgggcggtgagccagccatccagcagtgcgggcatcagcagcgaatagggcagcacaaccgcagtgaacagggtgaacggcgcagacgcctcgtacacgccgaacaacagaatcgccagaaacaccagcaccggctgtcccatgaaaaacatcaggtaatacccggcggtccaggcggccggactgcgcaccgccagggccaacatatggcacagggcaaacatgccgcaccagataggcagggccccggccaggcagaatcccaccagagccagcccctccagggcctcctccggctccccccggggcaggaacagccacccgccggccaggctccctcccaccagcaccaggcagaaggccagccccaacagcagggcggcgcacagctttccccaatagaccgtcccccgccgcaggccgaaggagagctcatttttcaaggtatccgccgtgccgccatccacaagttgcaccagcaggggcgcggccagcatgcccaccaccatggtgaccgaaatccccttcgccaggcttgaaaagccgccgtagctgtagagcatgaaaaacagggccgtacacagaagcaacagggccagcaggacatagacgccgcgccggtggaggaccttccacagctccgccttaatatagttgagcatggactcccaccttccccatttatcggatgtcccggcgggcgaataacgccagccctgccgctgcggcccccagggtccacagcagtcctacgccccaggtccagcccagccaggccgggctccagagagggacctccatcacgtccatgggcgcggtgagcagcaggtgatagagcatctccgctccgcgggccagccagtccaccccggtgcgcattaccatgcgcaggacagaactcaggccacccaggcaccccagcaccaccaccatcatggggatggtatgggcgagattgaacatggcggccaccgtcagggagagggcccccatccagaggggcagggcacccagcaggcggaagaggaaggtctggatctgaacccagtctcccaccgctccagggagcagtacccggcagagcacagcatagaccagcagggtcaggaaagccagcacaagaccaatccctgcggcggtgaccagcttgcccagatagatgcgcctacggggcaggccgaacgagacttcattcttcagggtatcattcttatattgatcggaaaagacctcgtccgccacgaccaccgccagatagaggcccaccgtgaaaaagggggtcagcagggacaggctatctccgaagctgccctgaaacatgtcgccgaggccgaaccgccacaggaggggcagcccggcggccagggccagcaggaccagcaggaatgcccggaaataagggcgggccaccgccctgccccattccgcggtcaggtagtgcttcatgcgctcccctccctaccggatctctttccggcggaaggccagcaggcccactgccgtggccgccgccagccacgccagcccggcggcccagcacaggcccacgtagttccactgaaaggccatgtttttcaaattctccagcatgaccccaggcataaactgccgcagcacctcaaatgccgggtggaacaggattccaaacgcctgtagaatggcgggcaataccgccagcagtcctgcggccgtgaacgcggctatattcgtgccccgcaccaggaaatagcaggtattcaccatggcctgggcggccagccacaggggaaacgcccccgccaagcagtagccgatgagctgccaggccatgccgtccagctccgtatgggggaacagcacccagcacagccccagatagaagcccatcatgaccactgcggcaagcaccgcgatgcccgtagacacgagcagcttgcccaggtagatacgcccgcgggacaggccgtaggacacctcattttttaatgtattgtttttatattgctcggagaatacgatatctccggtcacaatcgtggcgtacaggccaatgctcagcatgaaaggcaccatgatggccgtggaatagaagtccacgttggaattgccccacttccaggtcgtccagtaaccccacagcagcaccgcctccaggcccaggcagacggccaggatgatatagaaatattttctgcggaaggtcttgtagcactcggcggccagatagttacgcatggcggacacccccgatcatggacaggaagtagtcctccagattggcaccccggctctcgatgctttggagcgccacgcccccttccaccagggcctgagcgacccggtggggcgcgtccagactgctgtagatacgcagcagatggccaggcagcacctcgtagtcgcggatgcccaggctctgttccagcaccagggccgcacgggaggcgtcgtccaccctggcctcaatacaggcgcggcacttttcctccagcgcccgggcggaaatctgctccagcatcatgccgttgtccagaaagccgtagcaggtggccagattggccagctccgacaggatgtggctggagatcagaatggtggtctgccgctcctggttgagcctgagcagcagattgcggaactccacgatgccctccgggtccaggccgttgatcggctcgtccagcagcaggaggtccggccggttcatcagcgccagggccagccccagccgctgcttcatgcccagggagaagttcttgaaggtcttcttccccgtgcccgccagatccacctcctccagcacctcgtccaccacccgccggcctggaatgccccgctggatgcggtagtactccaggttctgccgggcggtcaggtagggatagaagctgggcgtctccaccatggccccggtgcgggcccgcattttggacagctcccgttccccggaggcgccaaacagggaaacctccccctccgtcggtaccgtctgggccgtcaccatccgaatgatcgtggtcttgcccgcgccgttgcggcccaccagcccataaatctgccccttctggatggacagctccacatggtccaccgccagatgattgccatagcgcttggtcagcccgcgggtcaccaatatctcatttgccatttggcatccgcctttctcatagatcttgatgccagtataatggaaaggccataatctgcctttaagcaaaggtgaagaatttcttaaccggagcgaccgtggggccgcatcacagatcgctcattttaaagccgatgccccacaccgtcttgatatactcggcggggctggccttggccagcttagcgcgcaggttagagatgtgaacgttcaccgtattgtcgtcccccatgtactccccgccccacacctgctcgtagagctgctcccgggtaaacaccttcttggggtgctccatcagcagggtcagaatatcaaattcccgtgcggtgacggtgacgggcttgcccgcggctgtgacggtgacgctctcccggtccagggtcaggtctccatgggtgagcacggcgctcccgcccccgccggagaactgcttgtagcgcctgagctgggcttccacccgggccagcacctccgcgttgtcaaagggcttggggatgaagtcgtccgcccccagccggagcacgttgacccggtcctccaggcccgccttggcggagaggacgatgatgggcatggtcttcttttggcgcatctgggcgatgaattcctcccctgtcaggccagggagcatcagatccagcagcaccagatcgtactcgtattgtccggcccacagggcggcctcgctgcccgaaaaggccgggcggcaggcatagcccgccccctccaggatgcggcagagcagcttgttgatatcggggtcatcctcgaccaccagaatgttgcagatatccattctatttcaccctcagtcgtttggccagctccgggtccgggtccactacggcggtctggtaggtcgtatagaccaccatgcccggccgggcgccggccggcttcttgacgtactttaccggcgtatagtccaccggcacccggcttccctctcccgcctgggagaaggtggccgccagaatggccgcctcggtaaggctttgggcgtcggcctcgcccccctccagccagaggatcacgtgggagccgtggatcttctgagtgtggagccaaatgtcgctcttgtaggccagcttggtggtgagctgatcgttctggctgttgtttttgcccaccgagatgcgcagtccggcagaggagcggaactccatgggctttccgctcacccttttctgccgcttcgccgccgtcttgccccggcggaggtagccggtctccaccagctcctgacggatctcctggagatcccgctccccctccgccagggagaggttttccaggacgctgttcagatactccagctcccgcgtccccttttccagttggatggtgagcatctgctccgccgtcttggccttgttgtagtccttatagtacttcgccgcgttctgctggggcgccagaagggggtccagccggatctccacctcccggccctccgggtcgtagaagtccaccacccgcaatacttccatcccccgctccatggcgtggaggttggaggtgaggatgtcccccagctcccgcaggcgctcccgatccctggtggcctccagctcccgggtctggttggccagcttgcgggccgtgcggtcccgggcgctggtcaccgccttgaccaggtcctgcccccgctggcgcacccggtcggccgcctcccggcgctcgtaaaactcgtccagcatttgggagaaggaagcctggggccggctttccgtctccgggccatactggaggatgggcagaacggtgaaatccaccggcttgccctcccgcaccagcaggtaaggtgtaaggccattttcgtttacattgtttttgagtttctccagctccgccgccagccgctcccggtcgccgccggcgcggaaggccagctcccgcgccaccagaggcgacaggccggtgaagctgtccagcaacagcttgtcccactccttgcctagggggttctccagcaccaggcgcagctcctccggctctatcgtaaagggattcagcttgtcgggcgccggcggctggcgataaaacaggccgggcagaagctgccgctgaccccggccaaggtcaccgtccacccggcggatgcagtcgatgatgcgcccctccccgtccagcagcaggaggttggcgctgcggcccatggcctccagcaccaggcggcgctccacccggtcgcccagctcgtccagggtctccagccggaattccagaatccgctccagaggcggctggttcagctccagaatccgcgccccctggaggtgtttgcgcaggagcatgcagaacatgggaggctgctccgggttctcccggtttagggtggtcaggttggcccggggatggccggggttggcggagaggagcaggcgcacgttctccccctgcccccgtacataaagcaccacctcgtcccgggtgggctggtagagcttgtcaatcttgcctccggccacggcggcacggagctccgcggccaccgccgtgaggcacagtgcgtctaacggcattcctcttcctccatgatcacagcaaacagttggttgagccgctctgtgcggccctgaagccacagccagccgaacagggcctccagcccggtggcggcctggtaatccgcccggctggcgttctggggcacgctgtgggggctggtattgcggccccggcggaacacgtccccctcctccccggtgagcagggggagaatccgctccaccgcccgggcctgggccggggcggccacatagcggacggtggctcggtggaggcccttggaggtggccttgccgtggaggcacagccaggagcgcaccatcagctcaaacacgccgtcccccaggtgggccagccccaggctgctgatggcccgtacggtgtcgggcgcggcattcagatggaaataatcggtcataggtatgttcctcatttatctctcgaataataggatagtataacgcaaatccccacagaaaacaacaaggaaaggacgacccgccatggatatgcactatccctaccaacttcccccgctgccctatgcctacgaggctctctctcccaacatcagcggcgacacgctccactttcaccatgacaagcactttcagacctatgtggacaacctgaacaccgccctggccgactgtcccgagtgtcagtccaagccgctggatgagctgctcaaaaatctggaccggctgcccgaccccaaacgcaccgctatccgcaacaatggcggcggggtatacaaccatctgctctacttcgacggcatgtgcgcctgtcacagctcccgcccctccggcgggctggccatggccatggagcgggacttcggctcttttgagggttggaaggaacagatgaaggccgccgctctgggccagttcggctccggctacgcctggctggtgagcgagacctcgggaaagctgtccgttatgaagctgcccaaccaggactgccccctgtccatgggactgtggccggtgctctgtctggacgtgtgggagcatgcctactatctggactaccagaaccgccgggccgaatatgtggaccgctggtttgagcgggtcaactggcccttcgcccaagagcggtatgaggggtgcaggcaataaacaaggagcgccgccctattggacggcgctcctcgtttacgtgcgcatcagacgggtcagcacctgtctgcaaggccggaacagcaccagcgccatggcgaagtttccggcgcagtggagcagatcgaaggggatgccgcttacccaccaggacagggcgaaggcccatcctccggtgacccagtacactagggcgcacagcgccccgaagctgagcccgaaggccccggagagcactgcccagccaaggggagactccatcttccggaacagcattgccaacaccaccagcaccagccacacataggtatagcagaggttccaaaagccaagcccccagatgaggatctccatcatcacatagacatagacgggggccagggctttccagcccagtaccgcagtatagactaggacaagcagagaaaccggctcgatattgggcagccaggccagggccagcttggtcaccagcagcagcgcgcccaacagggccaggagcaccagctcccgcgcccccatgggcctgtgcttacccgaggccgtcatagcccacagtaaaggtcaattcaaagtggtctccgtcggcaatgggggtgctgtcagcgctgctgttgaccatttctccgcccttggtcagcttccaccactcctgtgccccctcgtccacggtctcgccgtccacggtcagcatatagaggccgtaggggccctggttgtcctccaccacgccctcagccgtcaggaccgcgcccagataggcctccccggtctccagggtgaacacccgttcctccccgcccttatgcaaaacctgaacggtgatggtcttttcccctgcctcccccttgggcgtgacggctcgccataccagcaacaggacggcagcgatcaccaccagggcggccaccgccaggatggtctttttcttgctctgcaatgctactcctcctttggtcaagtagcgccagtttaccacatttttcaaccagtttcaactttaaaaagagccaggccggtaaacggcctggctccgtggattggctttactgggggcgctggttgctgaaacgggtataggcagtgccgatctggctggccggggcctgctccacctgataccagcccttctgctgcgcggtctggaagagcttggtctgggtctggtggccctggttgagcagcttgagaaattcgtctcgaagctgcacgttgacacactccgaggcgaaggtgtcatagttggcgctcatcttcttttcggtcagaatcaggtcggtgatccgctcctggtcgttcatggtcattccctcctttttatttcaggtagccaagcagacaatcatagttctgccggtgctgatcggcatactgctgaaagcagggctttagatcttcctcggtgcactcctgagctgcctcctgatacttgcaatagagggtcttttcaaaattgagctggtcggacagggcggtcagctccttggtggttaggttcgccatggcgcgtctcctcctttgtttggtttgccccaatagtttgccccgcctgcgccggcttatgcggcagccggggacagccgccggaccaaaagggaaacaccgcataaaattccccattcatccgttccacgcgggcaaagcaaaacagaggcgtcagcggaaacgcccgcgtctccgcatagggaaacgccagggaaaacccctccggttccggccggtacagcgcccgccccccgccagccgcccgggccagcaggggttcccccattcgccgggccggcgcctcctcccagtgccagccctccggggaatgcggaccgccgggcgagcccgcggaaaaggccagctccgcccgggcgcctgttggcggccaggccccctgccgccgcagctcgtccagagagagggtgcgcctcagcttcagtcggccgtcctccggcaggaaggtgcccagcagggcccggcctcccgtcccgcagaggtaacctttatagagcccctttccgtcctcgggcagctctgccgcgcaccgcgcccggccgccgctctcctcgatggtcagccagccctgtccgccggccagtgaaaaccgctccacacaagcgccccccttctccgccctttccttctattctatgcggagcagggggtgaaatgcgctgtaaaacggttgacaggagcgcggacgcctgctatactgtgtgcgacttgaaaacgattggagctgggaagatgcgcaaataaccctttctttgtttggagtccgaccggcggcccgcgggccgtctctttgttgtactccggcagaagggttatgctgtgcacttccccttatggtacccatttttcgggacatgggcgcggaagacgaatccttctgcgcccatattttgtatttgaggtgatctatcatggctctgatcgacatccgggatctgacctttgcttatcccggcagctacgacaatgtctttgagcacctgagcctgcaactggatacccactggcggctgggtctggtggggcgcaacggccggggcaagaccaccctgctgcggctgctccagagacaatacgaatacgacggcgcgatttccgtgccggtaccccttgactgcttcccctccccggtgtccgcgccggagcgggacaccctgaccattctggaggagcaggagcccggactggaactctggcgtatatacaaggagctggacatgctgggggtggatgccggggtcctgttccgcccctactcctccctctccggcggcgagcaggtcaaggtgctcctggccgccctctttctccgtgagggggccttccttctgctggacgagcccaccaaccatctggatctggagggccgccgggtggtgagccgctatctctcccgcaaaagcggcttcctgctggtctcccatgaccgggtatttctggacggctgtgtggaccacatcatggtcatcaacaagcgggacatcgaggtgcggcagggcagcttctcggcctggtggcgggacaagcaggcccgggacgactgggagcgggcagagaatgcccggctgaagcgggagatcggacggctggaggatgccgcacgccgcactgcttcctggtccgaccgggtggaggccgccaaaaagggctgccgcaactccggacttcgccccgaccgcggctatctcggccacaaggcgcaaaagatgatgaggcgctccaaggccgtggaggcccgccggacggaggcggcggaggccaaggccgggcttctgaagaacatcgaactggccgaggcgctgaagctccgccccctggagcaccccaagcgctgtctgctggaggccagggagttggcacccgactacggggcggggcccgtgtgccgtcctgtctccttcaccgtggagcggggggaacgggtggctctggtggggcggaacggctctggaaagtccagcctgctccggctggcgctgggtgaggagatcccccacacgggacttttctcccttgcctcgggtctggtcgtctcctacgtgccccaggacgcctccttcctgcggggcagcctgagccaattcgcgcggcgctatgaactggacgagacacagttcaagaccattctccgcaagctggacttcgcgcgggtacagtttgaaaaggatctgtccgattatagcgccgggcaaaaaaagaaggtgcttcttgcccgcagcctgtgccaaagcgcccacctgtatgtgtgggacgagccgctgaactatattgatgtcttctcccggatgcagcttgaggagctcctgcgggcctgccgtcccgccatgcttctcgtggagcatgaccaagccttcctggagggactggccgataagcgcgtcaaactagttcccgcctgaacgacagacgaaccgcaaactgcggttcgtctgttttttgttcccgacccttgacaacaccattctattgcggtagaatccaattgtattctattgcaatagaacagcatagaaaggagcttaccgatggaacttaagctatttgactcggagcgcaaggtcatggaggtcctctgggaccacggcgatctcagcgccaaggagctagccgaccgcctgaaggagctggtgggctggagcaaaactaccacctataccgtgatcaaaaagtgcattgacaaaaaggcggtctcccgcagtgagcccggctttgtctgccaccccctggtcagccgggaggaggtgcgggaacaggagacggacgccctgatcgaccggatgtacggcggctccgccgacctgctggtggccaatctgctgggcagccgcaggctctccccggaggaactggcccgcctcaagcggcgcattgaagaattggagtgattgtcatgctgtctctgctggaactgagtctcaccggcggcgtgttcatcctcgccgtggttgtggtacgggcgctggccatgaaccggctgccccggcaggcctttcttctgctctgggccgtggccctggcccgcctgcttctccccttctccattccctcccccaccagcctctactccgccgccggacatctgggcgagggcttccgccgggcgggcatcgtcaccgccggaggcacagatgcggcgggggccgcagcgcaggaggcggtcatcccctggatggccctgctctgggccgcgggcgctctggcctgtgccctgtgcttcctgctcccccacctgcggggccgcagggagtggaatgcctctctgccggtggaggacccctttgtcaccgcctggctggacggccatcccatccgccggagggtacgggtgcgctgctccgaccgggtggacagccccctcacttacggtctgctccgccccgtcatcctcctgcccaaaacgctggaccggagcgacgtgtcccggctggccttcgtgctcacccacgagatggcccacatacgccggtttgacgccctctccaagctcctgctggcggccgccgcctgtctgcactggttcaatcccctggtgtgggtgatgctggtcctagccaaccgggatctggagctctcctgcgacgcggccgtgatgcgcctctacggcgcggaggcccgcgccccctatgcccgcaccctgctggagctggaggccaggcggtcccgcttcctccccctgtgctccgctttcaacaaaaacgccctggaggagcgcatcggcgccatcatgcgctcccgcaaaacctccgccgcggcgctggccgtagccctggtgctggtggtggccctcaccgccgtgctcgccaccaacgccccccgggaaaggccgatcgcctccgcctccggcctgaccatccgggacaatggagtggtgacggcctaccaggagggcgtctgggactcctccggggagctcaaacccgacccgcagaccggccactattacacgaaggagcagtatgaacaggttgccgcgctgaaaactgagggatacgagtccctgtccatcgccaaattcaaccgcacgctctacgctgcgctgaacgagagcgaggcgctgtccgaggcctttgggcgggtgctgatggacctccccgaaaccgatcccctggcccccttcctggtcaacaccgcccagccctccctcaacgagtacaacgcccggctgaatgaggtgtattcgggccgggcggaggaccccaccttctccggccagctcacccgcaccgagaccgccaacgtatacggcgacacggtggaggtgggatggaccgaggcaggctactccttcacctaccggattctggaccaggacgggctgaccgttgccgagcgcgacgccttcctccagtccattctcaagggtatgcaggactgcctggacggcctctccacagaatcgctgcgcgacgagggcaagctcaagcagaccctgcaggccgagctggaccggctgggtgcggccgccgctacggggcagatcgcgtatacaggcggcaccgtggagggctgctggtcggaggcggcctatgacggctcgggtacgcttgtcacccacgatctggtcatggagggcatggcatgaggaaccggctggtcattaccctctgcgccgtggtatccctgctggccggcgccggcctgctcaccttctggctggtccgctccctggcccccgccgctgcgctgaattacacaccctggcccctctcccccgaaccctatacccaggcggatctggacgaggccatggccctgcgcaccgagggatatgaggcccagtccgtcgcagcgttcgaccgcgctctggcggattggaccaatgaggccgccttccacgcccgggaggaacgcattcgccgcctgctctgctcctatgaggaggacggacccgaggccgaatttgtcctcggtaccctggccgccgccatgggggcctgctccgcccggcactacggcggctactgcacacagattaccccggcctatacagacgctgccgcctatacccggtccgaggacgtattcggcgactcctacgtggtctatgaggcctccgcctcctacaccatccgctaccaaatgccggacgagagcatgctcaccgtgggggagcgggaccggatcctgaccagctaccgggacgcggtgcaggcctttctggacggcaagacggaggacgagctgtcgaaggaggaggccatgacccgtgccctgaagcgggagctgaaacggctggaccagtccctgtccacccagtggatggcgctggagggcacccggctcgacgactacttcgcctatggcccggaggggggcgagacaccgtgaggctgtccgccctctccctcaagctcatcgccattgccgccatggtggtcgaccacatcgccttcacctttgtcccctatgggacacccctgtggaccgtcatggacgccgtcggcaagctcaccggccccatcatgttctatatggctgtcgagggctttcaccacaccaggagcatccggcgctatctggctaggctggcggtctttgccggcgtcagttacttccccttcctctatttctgcgccatgggtcagccggagcagatggaccccctgcggctgaatgtcatctacaccatctccctgggggtgctggccgtctgggtgcgccgccgcccctggcccgcacccctccgggccgtcctgctcctcctgctggcctgcctgagcatctccggcgactggggcatctggggcttcagcatcatcgtcgtgctggacttctattacggcgacttccgcaatcaggccttcggctacacactggtcgtcctgtttgccgtcaataccgtcagcctgctcaccggtccggcctatgacctgctctatctgggaggcctgtccagcccggcggactacctgctgggggtggaaaacctgggcatgttcctccccctgctcctcctccggtattacgacggtacccgcggcaccgaccggccctggggcaagtggctgttctacctcttttaccccgcccaccttctgctgctcggcctgctggcccatattctcctttagaaaggaagttttccccttgtcccaccggaacacacgcatcttgtccggctgcgccgccctgctgctctgcgccgggctctccggctgccggtctgtgccggcctcccggccctccgcctcccctgaccctgcggcccaccttctgggcctgaccgctgaacagcggatggaggattacgagtacctctggtctaccctgcgggacagctatccctgctggggtattctggagcgcgagggcgttgaggtggagcgcatctacaccacctaccgggaaatggtggcggaaagcgacagcgacgcagacttttacagcgccatttacagcgccctctaccttctgggcaccaacggacatctgagcataatcgagccggaggcctatttctccgattacctccctgccgccggccagtaccgccgggagggaaaaacgcactgggcggaagtgctggacagcacggacactcagaccaggtaccggaagctcctggccctggagcaggccgccaatgggacggacgcggagtcctccatccccggctccggcggtgatacacccaacctgaccacgcttctccttccgggcgggacggctggataccttaaaatcgaccgcttccccgccgactatacttccgatgccgcggcgctggaggcgttctacctccagtgcgccggttgtaccgacctgattctggatctgaccgacaacagcggcggcagtgagctctactgggagcagcttctggtggccccccacattgaccaccccctgtccagccggcacttggccctggtgcggcggagcgccaacaacaacccttatctggacgaggccttctccccctccgccttccgccccctctccactctgccggagctgcccgggctggatgccgcggaccgtgccctggccaccgatgtgcttaccgtctcccataccgtggaaccggcggcaaagccgagtccctttcgcggacgcatctgggtgctggtagatgaatcggtctactccgcctctgaatccttcgtcctgttctgccaacagaccggctttgccaccctggtaggccgcacaaccggcggcgacgggattggcgctatggatccggtctaccttcagctcccgaacagcggtatcctgattcaatataccgtcccatttgggctaaaccctgacggcagcagcaatgaggaaatgggaaccacccccgatctggtctccccggcggaggaaccgccgctcattaccgccctccgggccattggggaggcataataacaaaagaacgggcggcacaattccgtgccgcccgagcagccagtcgaaaagtcttttcgactggctgccggactttttgaaccttctaaaaaagttcaaaaagtcgtttgatcccacgcgaaagggaaccctgacgtttccctttcacactatccctccctccgaagccttcaagcaggaggagctattgaccatttcagtgggcggcacaatctgtgccgcccactcttctgtttattgaatgctgtaggtcccccggaccaggagggtcacggcggtggaagccttgacgccccggccctcaatggtggccagatacagatggttggccgtcagggccccgccgccggccagcgtcgttccggcggtcatgtccaccaggccgggggaggtgtccgaaacgcaggtagccgtgccgctgcgcaggaggaattcacacgccgcgccgccggtgatggtttgcccggcggagaggttgactacctgataggatgcgccgccggagggctggacggagcttcccccgcctgaggatgccagcttgtcctccacctccttgacatagccttcgaccacggcggagagctgcttcttcagctccgtctcccgggccgtgagcttgctgtccacctgggacagaatggatggggtggctttctgagtcagatagctcagcgtcaccagcgggtcgctctggctcccctgctggcctgcggcaaaggcaacgcccaccagggtcagggtcaccaggcacccggctgccagacgggcgggccaatgtgttttcttcatatgtacgtcctccgtttgggaagcggggccgcccgccggggcggtcccgtgcttccatttttaaaccatggtgtccgtatgcaggccgaagctgaccgcgatggcgttgtccacccgctgcatctgcgcttcgtccagccggcccatatgctctctcagccgccttttgtccagcgtccggatctgttccagcagcaccaccgactccttgggcagtccgtaggtgttggctgagagctcaatgtgggtgggcagacgggcctttccggtctgagaggtgatggcggcggcgatcacggtgggactgtggcggttgccggtgtcgttctgtacgatcagcaccggacgcacgcccccctgctcactgcccaccaccgggctcagatcggcataaaagatgtctcctcgttttacgctgttgtccacaaaagctcacactccgccggaatatagtcaccagcgtcaccaagcacagggcttatgtaacgcggtcactatgattctcccacggggcggcggaatttatacacagggtttcaaaaaacaggaagtccccgtctctctccgccgctgcgccggcatccctccccgaaccattgtatgcccggcggggccgccgtgtgagcggacgctcaattcaagtactcccggggcacccggggagacacggcgcagagcaattcgtattggatggtgcccgccagagcggcggcgtcctccaccggcaggtgttcgccgaagagctccacctcgtcgccgggggcagcccccagcccggtggcatccgccatgcacatgtccatgcagacacggcccacaataggcgcccgctgtccgcggatgagcacctccagccggtcggagcacagccggggcaggccgtcggcatagccgacggtcagggcggccagctcggcgtcccgctccagcacatgagtacagccatagcttaccggcgtcccggcggggacggccttgaccgaggccacccgggtcttaagcgccattaccggtcgcaggccaacgccgtccaacccctcgcaggaggggtcgggatagtggccgtacagggccaccccggggcgcaccatatccagatgagtacagggatactttaacacagcggcgctggcagcgcaatggcggattgggaacgtgattccccgcccctccagctcggacagcagctccagaaagcgggtgaactggcccatggtgtacgcctcgtccccgtcggcattggcgaagtgggtatagatgccctccacctccaggccgggcagggcgcacaccgcggcaatggcgtcggccgcctccgtccggtgtccctcatcacacagccagcccagacgggacataccggtgtccgccttcacgtggatgcgcagccgcctccctgccgcctgggcggcggcggaaaaggctctggcactctccagatcgtagaccgtctgggtcagcccatagtgtagcagctcctccgcgcagtcggttggcgtgtaacccaagagcaggatcggggcgcgcaccccggcctcccgcagctccctggcctccgccagacaggccaccgccaggtactccgcccccagctcctccagcttccgggccacggggaccgccccgtggccgtaggcgtcggccttcaccacgcccagaaatcggcacccctcgggcagcagcgcccggagtgcgcggtagttgtgctccaaattgggcagggagatctccgcccaggttcgtctctcctgttgcttcatgctttcgcctctctgatatgggatcatccgctccattatactacgggccgggccgcggcacaagccccgtccgcccggcgttttcatccatttttaatgtactgttcatagaaatcaaaagacaaacagggaattttggtctatactaagggcagaaaccagggccgggaccggcccgccttccaattcaaataaggaggattccgaattatgtgggaagactttggcaaagcattgacaaatgtggccttcgctggtgtgggactggccgcgctggccgccgaacaggtggtcaaggccggaaaggtactggcggaaaagggcgaaatctacgtggagcagggcaaacggtatggcgaggagctccagcagaagctccaggaggacgcccagcgccgccgggaggagcagttggagcagcgcatctccgccatggacgctcaggagcgcgaggccctgcgccgccggctggcggagctggacgagctggagcggcaggcccgtgaggccgctgcccaggcggaggaggccgcgcccggcgagggcggtgccgagatcaccgagatccacggcggcccccaggagcacgacagcgaggaatcatgaggcaaacggccaggcggggtgctgccccgcctggccgtttgctatgtgttctctccaaccgtgaactgaaactccgtaaagacacactggatcacggtaaagccgtcctgagacagctccccccgcagaagggcgtgggtggacgggtcaaaccaaagggagcactcccgcccctcgcccgcggcggactccggctcccggcagaccacgcgcagcacctcgctctccccttgggcctccataccacattcggcgatgaagccctcctgcacatagtccatcagcaccggaaccgcgtccaccggactcatgccgctgtcatccagcggcccagtctccacccgcatgccgtcgtactccagagcggtctccccctccagaatacgggcggtgaccccggcgatattctccggcgcagtgatggtcagggtggtctccccctccctggcatagttcaggccgattccataggtatacacccgctggccgtagtcggccgtcagctctagggaggcggtacagccccccatctccagatactctccccgtatgtccagggccagttgctcagcgcggtttccgccctctgctccgccgcaggcggacagggacaagccgagtatcatcattagtacgcacatctcggtccgatggcgcacagcgctccctcctagctcacgtgttcctcaatgacggccggcagggcggcaatcacgtcggttggggtcattccatactctccaatggcgcgggcacagacctcccccgcctctccgtggagccacaccgccatgggcaccgcctgccgggcaggcaggccctggcccagcagagagaggatcagccctgccagcacgtcgccgctcccccccttggccatgcccggattgccgttggtgttgatgtaggccgagccgtcggggaaggcggtgatggtgcggtgtcccttgagcaccaggcagcaggcgtgctccacggcaaaggcgcgcgccgccccaaggcggtcgcccgacgacagctcgccccccagccggacaaactccccgtcgtggggagtgagcaccgtgtgcagtccccggcggctgtccaagacatctatatgtccctccagcgcatttatgccgtcggcgtccagcaccacgggcaggtggatttccccgagcaggtggcgcaccactgcggccacgccgtttccgcggcccaggccggggccgatcaggcagacgccgcagccggccagccgggtcattgcggcttcccccgcctccagggagagctgcccctccttgcccgcaggcagggggtggggcatggcctcatccagcttggccgccgcgatgggccacaccggggccggcactcccaccgtcaccaggcccgcgccggagcgcaccgctgcctgagccgcgaacaccggcgcgccggtatagcccacgctgccgcccaggagatagacctttccaaagtcccccttgtgggcgtcccggggccggacgggcagacggacatccgccccctccaccgtctgtaccggatagtcctccccgtccaccaagtcccggggtatgccgatgtccgccacggtcagcacgccggtgcacaggccgcctttgcccacataatgccccgccttgggaagcgtgaaggtgaccgtccgcgccgcgcgcaccgcctcccccagcaccctgccggtgtcggcctctaccccgctggggatgtcggcggacaccaccgggatgtcacaggtgttcatcatgtgaacggcggtgagggcgtccccccgcacctcggtgttcaggccgataccgaagatggcgtccaccatcacgtccgccttcaggcaccaggccgcgaagtccgggtcgtccggggtaaagggctccagtaccccgccggccgccgccagccgggcctccatggccctggtgtcgcaggtcagcttctcccgctgccccaccaggatgcagcgcacctcgaagcccgcctccagcagcaggcgggcgcaggccacgccgtcgccgccattgttgcccggcccgcagaaacaaaccgcccgccccggcgcgttggccgccgtgtcgatggcggcctccgccagcgcatttgccgcccgctccatcagctccagcgaggggacgccccgctcctctatggccctccggtccaatgttcgcatctgctccgccgttgcgattctcatgtgttccacgctcccatttctctctaagtcggtctcattatatgccgtgcggcaggactcgtcaatttccttcttgcgcttttctcgattttgtgatataaataagggcacatgcgatgaagggaaaaagagcagcccccggcccggcagagagcgtccgtcaccggctgaaagcggatgtggggctggcctgttcggttcgtcctggagcggccctggagacagggacggttttgccccacgttaccggggccaaagtgcctgcgccgcggcgcgggaattgcgggtggtaccgcggaaggtttgcctttcgtcccaattagttgggaggaagggcttttttattgcccaaaccggaaagaggagctggacaatgaagtcgttggaagagcgagaccgcgccttgattgaggccgccggtgcggcgattcgccggaactatgacggcgaaaacttccatcacaccgtaggcgcggccgtgcggtgcggcagcggcgcagtttataccggcgtgaatgtgtactccattcacggcgcatgcgcagagcaggtggctatcggctccgccatcaccaatggcgagcgggttttggaggcaatcgtcgccgtccgcggcaaagacggctcggaactgctgcccccgtgcggcagctgtcggcagctcctggcggactacgcgccagagtgtgaagtaatcctccccgtgaacggggttgcacaaaaggttccggcaaaggatctgctgcccttcgcctaccatgcggaagcctaatcgtatccactaccattcatcaagaaggagttttccatatgaaagaacagttagcaaccatccgctcggaggctctggccgcgtttgcgcaggccggatcttccgcagaactggacgccctgcgggtcaagtatctgggcaagaagggcgagctcactgccgtactcaagcagatgggcaagttctccgccgaggagcggcccgccatgggtcagctggccaacgaggtgcgcgccgctctggaggccgagctggaggccaagggcaaggagctggaggccaaggcgctggaggcccggctggaggccgaggcgctggatgtcactgtccccggcaagcccgtgacgatgggccaccggcaccccatgtatatcgccctggacgaactcaaggacatcttcatcggcatgggcttcaccgtactggacggacccgaggtggagctggccgagctgaacttcgaccggctcaacgccggcgaggggcaccccagccgggactggtcggacaccttctattttgacgaggacagccgggtgatgctccgcagccagacctcccccatgcaggtgcgggccatggactccatgcccctgcccatccgcatcatcgcccccggccgggtctaccgcaaggacgaggtggatgccacccactcccccatgttccaccaggtggagggcatggtcatcgacaagggcgtcaccatggccgatctgaagggcaccctcaacactgtggtggaacagctctacggcaagggcaccaagacccgcttccgccctcaccacttcccctttaccgagccgtcctgcgagatggacgtgcagtgccacaagtgcggcggtgtgggctgccccacctgcaagggtgagggctggatcgagctgctgggcgcgggcatgatccacccccgggtgctggagatggcgggcatcgatcccagcgtctactccggctgggccttcggcatcggcctggagcgcaccgccatgcggcgcttcaaaatcgccgatctgcggctgatttttgaaaacgacgtccggtttttggagcagttctgaggcgcagcctcagaaccgtaggggcggctatcagccgcccgcctgtttccgaatttgagcctggcgggcggataatatccgcccctacacccggaatccgtccgaggtaaaacaagaataacaagggagttttcatatatgaacttatctcgcaaatggctggaggaattcgtccatgtggacgcctccgacaaggagttcgccgaggccatgaccctgtccggctccaaggtggagctgacccacgatctgggagaggagatctccaacgtggtggtgggcaaggtgctgtccatggagcggcaccccgattctgaccacatgtggatctgccaggtggacgccggccgggagcagccggtgcagatcgtcaccggcgcctggaacgtccatgtgggcgatctggtacccgtagccctgcacaagtccaccctgcccggcggcaagaagatcgagaagggcaagctgcgcggcgtgctgtccgacggcatgctgtgcggtctggccgagctgggcctggacgagcgggacttcccctatgccgccatcacccccgccgccattctgggggactacaagcccctggacaaggacaagccctccatctccgccgacattcagcccggcgacaagatctacggccccgtggtgtgcgccaaggtgctggagtgtgagacccagccggacggctccttccacacctgcgcggacatcggaaccggcacggtctgcccggacaccgcctgccccaacctgcacgcaggcgaccttgtggcctacaacaccaagaccggcagctactgtaccctggacgaccttcacgcccagcaggcggaattcccccactgcatcccagacggcatctttatcctccgcgaggactgcaagcccggcgacgatctcaagcccgtcatcaacgccgacgaccatgtagtggagtttgagatcacccccaaccggcccgactgcctgtccgtcatcggcctggcccgggaggtggccgccacctacgacgcccctctcacgctccacgagccggtggtgaagggcggcggccccggcgtgctcaccgagctgctggacgtggagaccccggcggccgacctggtgccccggtacaccgcccggatggtgcgcaacgtgaagatcgccccctcccccaagtggatgcgggagcggctgcgctccatgggcgtgcgccccatcaacaacatcgtggatatcaccaactacgtcatgctggagtacggccagcccatgcacgccttcgactaccgctatgtgaagggcggcagaatcatcgtccgccgggcggaggagggcgaggagctgaccaccctggacggccaggtgcgcaagctcaatgccaaccacctggtcatcgccgacgagacccgggccgtgggccttgcgggcatcatgggcggcgagaacagcgagatcgtctccgacaccgccgacgtggtgttcgagtccgcctgcttcgacggcacctgcatccgcaagggcgccctggccctgggcatgcgcaccgaggccagcgccaagttcgagaagggcctggatcccatgaacaccctccccgccgtccagcgggcctgtgagctggtggagctgctgggagccggcgaggtggtggacggcgtcatcgacatcctcaaccacgtaccccagccccgcaccatccgcatggatccgaagcgggtgaatgccctgctgggtaccgacatccccgccgcggagcagtacaaatatctggagcgggtggagatccacaccgagcagcacgacttccccgacggccccgccgacgtggtcatcccctcctggcgcgccgacgtggagggcatcgccgatctggccgaggaggtggcccggttctacgggtacaacaacatccccgtcaccctcatgcagggtcagaccaccctgggcggctactccgccgagcagaagctggaaaaccggctgggtgcgctctgccgcgccttcgggtatgacgagatcatcacctactccttcatctcccccgcctgctacgacaagatccgctggccccgcgactactccgcccgcaagagcttccagatcctcaaccctctgggggaggacacctctatcatgcgcaccaccaccctgccctccatgctggatatcctgacccgcaactacaactaccgcaacaagtccgccaggctctatgagctggcccgggtctatctgcccggaggggaggacggcctggccaacgagtccaaggtactcaccctgggcgcctacggcgaggacatggacttctacgccatgaagggggccgtcgaggccattctcaaggacatccgggctgtagatatccattttgagggtcccaccggcgcgccctccgacgcctcctaccaccccggccgctgcgccaccgtgtggagtggcagcgactgcatcggcatcttcggccagatccaccccctggcggcccagaactatggcgtggacgccgagctctactgcgccgagctctcctttgatgagctcctgaacgccaagggccccgatcccgagtacgtccccctgcccaggttccccgccgtcacccgcgatatcgccgtggtgtgcggggagaaagtcaccgtgggcgctctggaggactgcatccgccggggagccaagggcctgctcaaggaggttgccctgttcgacatctaccggggcaagggcgtggacgagggcaagaagagcgtagcctttaacctgactctgcgtgccgacgaccgctccctcaccagcgaggaggctgatgccgacgtgaaggcagttttggagctgctggagcaggagctgggtgctgttttgcggtgagccccttccgcgtccggtcgaaatcttaaagaatcataaattttaagtcatcccctttacagcgcgtcctttttccgctacaatggggaacagaatgatacacggggaggtgtaccgatatggagatggactacacccgcaaattcagcatccaaaacgacaaggacccagagatcaagaagatcctctcttccgtctaccagtccttgcaggaaaagggttacaatcccatcaaccagatcgtggggtacatcctctcggaggaccccacctatatcaccaactacaacaacgcccgcgccctgatccgcaagctggaccgggacgagctgctgcaggagctggtgaagcagtatctgcgcgattgattgtgttccatccaacgtgcgctgtcggtgacagcgcacgttttttcttttttattgcacctgcaacatacaacggcccgtccctttgttagaataggcccagaaaccgacgaaggaggcgttttcccatgaaacgcagaatcattcatatcgaggaatccaggtgcaacggctgcggcctgtgcgccgccgcctgccacgagggcgccattgagatggtcaacggcaaggcccgtctcacccgggaggactactgcgacgggctgggggactgcctgcccgcctgccccaccggggccatcacctttgaggagcgtgaggcccccgcctacgaccatgcggcggtcttggccgccaaggcggccagggccgcggacacgcccctgccctgcggctgtcccggcagccagagccgggccatccgccggccggaagccgcccccaccgctggagatatccccagtgaactgcgccagtggccggttcagatcaagctcgctccggtcaacgcgccctactttgacggctgtgatcttctcattgctgccgactgcaccgcctacgcctacggcgcctttcaccgggactttatccggggccgggtgacccttatcggctgccccaagctggacgaaggggactatagtgaaaagctcaccgccattctggctcaaaacgacatccgcagcgtcaccgttgtacggatggcggtcccctgctgtgggggcattcagcgggccgccgagcgggccgtgtccgccagcggtaaaccgctctccctccatacggtcattgtgggcaccgacggcacgctgctccgccaggcttgacacacactttacaattgtgtcttctgtttttccggcgaaacttgtataagcatacgaatttccgccccctcccttgcaaagcccccgggaattcgatatattatactcattctgggacagggaggtagagccatgacgccggtgcacgaactgcgctctggggtttggatcatcaatggttcccgcctgtccaattttcggcggtaataagtgcagggtatctgtgtaagcagataccctgatttattttatcgtttcctaaaaatttatttggcgctacaggagggttttatgagcaaaaaagttgccgtcatcatgggttccgactcagatctggacaccatgcgcccctgcatccagcggctcaagtcctttggcatccccacagaggtccacatcatctccgcccaccgtacccccgccgccgccgagcgcttcgcctctcaggcaagggagaacggcttcggtgcgattatcgccgcagcgggcaaagccgcccatctggccggtgtgctggccgcctataccaccctgcccgtcatcggcgtgcccatcaagacctctatgatgggcgggctggactcccttctgtccatggtgcagatgcccaagggaattcccgtggcctgcgtggcggtggacggcgcggacaacgccgccattctggccgcccagatgctggccctttccgacgaggccctgagcgaccggctggtgcagttcaaggccggcatggccgccgaggtggaagcaaaggatcataaaatccaaatggaggagttttaatatgtcttacgagaaactggagcagctctacgagggcaaggccaagaaggtcttcgccaccagcgaccccaatgttgtgatcgtgtcctacaaggacgacgccaccgccttcaacggcctgaagaagggcaccatcaccggcaagggggccatcaacaaccgcatgaccaacaacctgatgcgccgcctggaggagaagggcgtgcctacccactatgtggaggagctcagcgaccgggagaccgccgtgaaaaaggtgtccatcgtccccctggaggtcatcatccgcaacatctccgccggctccttcgccaagcgcttcggcgtggaggagggcatcgtgttcgacgcgcccaccatcgagttctcctacaagaatgacgacctgggcgatcccctcatgaacagctatcacgccctggctctcaagctggccacccaggaggagatcgacctgatcaagaagtatgcctttgcggtcaacgacctgctgcggggcttcatgaagaagatcggcattgatctggtggacttcaagctggagttcggcaaaacatctgacggcaccattgtgctggccgacgagatctcccccgacacctgccgcctgtgggacgaacagacccacgagaagctggacaaggaccgtttccgccgggacatgggcggggccgaggaggcctacgaggaggtcatgcgccgcctgatgggggatcagtaatccatgggcggtttcttcggcgcgattaccaagcaggactgcgtgctggacgtgttcttcggtaccgactaccactcccacctgggcaccaagcggggcggcatggcggtctacgaccggaaggatggctttcagcggcagatccacaacattgaaaacacccccttccgcaccaagttcgacaaggatctggcggaatttcacggctgctccggcatcggctgtatcagcgacaccgatccccagcccctgctggtgcgctcccacctgggcctgtacgccatcaccaccgtgggcatcatcaacaatgccgacgcgctggtggagcgttatttctccgaccacggccaccagttcatggccatgagctcgggtaaagtcaacgccaccgagctggtggccgcccttatcaaccagaaggacgatctgatctccggcatccgccacgcccaggacgagatcgacggttcagccaccattctcattctggacgccgacggcatcctcgccgcccgtgacaagctgggccgcctgcccgtgctcatcggccagggcgaaaacggctgctgcgtctccttcgagtccttcgcctaccataagctgggctaccatgacgcctacgagctgggcccccgggagatcgtacgggtcacggccggcggctggaagaccctctcccccgccggagagcagatgaagatctgcgccttcctttggacctactacggttaccccaactccaactacgaggggatgaatgtggaggtcatgcgctaccgcaacggggagatcatggcccgggacgaggtgcaccggggccaactgcccaaggtggactatgtggccggcgtgcccgactcaggcgtgccccatgccatcggctttgccaaccgcagcggcaagccctttgcccgccccttcgtcaaatacacccctacctggccccgctccttcatgcccaccagccaggaggcccgcaaccaggtggccaagatgaagcagattcccgtgcccgagctcattgagggcaagaagctgctctttgtggacgactccatcgtccggggcacccagctccgggagaccgtggaattcctctacgagtccggcgctgaggaggtccacatgcgctcggcctgtccgcccgtcatgtacggctgcaagtacctgaatttctcccgcagcaactccgacatggaactgctggcccggcgaaccatccaggagctggagggggacgaggggcagcagcatatcgaggaatacgccgacgcctccacggagcgcggcagatgcatgctccgcgccatctgcgagaagctgggcttcgactctctgggctaccagtccctggacggcctgctggaggccatcggcatcgaccgggacaagatctgcacttactgctggacggggaaggagtaaaaacgctccaagggggacgctgtcccccctggataccccccccgcgccgcccccggcggcacagcgggtttgatcccccctcacccgcgcacggcgcaggtggtcgcccgccgatggcggagcaagcagcggcgtactccggcgaactgaattcgcctgcggacctcttttgcaattcttttacccgcaaagcgggtaaaactctgcaaggctttttcctctaccccagcgccccatttcctcattgttatctggaggttttgacatgaagaactcccattccgaatcctacgccgccgccggcgtggacgtcaccgccggctacgaggcggtcaaccgcatcaagcccctggtggagtccacctacattcccggtgtcatgggctctctgggcggcttcggcggcctgttcgcccccaatgtggcgggcatgaagaagcccgtcctggtctccggtaccgacggcgtgggcaccaagctgaaaatcgcctttctcatggataagcacgacaccgttggcatcgactgcgtggccatgtgcgtcaacgacattatctgctccggtgcctctcccctgtttttcctggactacgtggctgtgggaaagaatgtgcccagccgcatcgaggccatcgtctccggcgtcaccgagggctgccgccaggccggctgcgccctcatcggcggcgagaccgccgagatgcccggcttctaccccgaggacgagtatgatctggccggcttctccgtgggtctggtggacgagtccgacatgatcgacggctccaccctctgcgaaggggatctgctcatcggcctgtgctccaacggcgtccactccaacggcttctccctggtgcgcaaggtgctgctggacaaccccaaggctctggatatctatgtctccgagctgggccgcaccatcggcgaggagctgctgcgccccacccatatctacgtaaaatccatccaatgcctgcgccagcacggcgtaactgtcaaggccatcagccacatcaccggcggcggcctgtatgagaatgtgccccgcatgatgaaagagggcctcaccgcccgcatccgcaccgcctcctaccccgtgcccgccatcttcgagctcattcagaagtcgggtgacatccccgtgcgggacatgtataacaccttcaacatgggcatcggcctggtcatcgccatccccaaggatcaagtgggccacgcgctggacgtgctggcccgggcgggcgagcagtcctatgtcatcggcgacgtgatcaagggcgacgccggcgtggagctggtctgagggcagggcgcatggtacgaattgccgtcttggtttccggcgggggcaccaacctccaggcactgatcgacgcccagagccggggtgagctgaaaaacggccgcatcgccgccgtgctctcctcccggcccgacgcctacgccctggagcgggccgcccgggccggcatccccggctatgtggtggcccggaaagacttcgcatccaaccgggagatgaccatagccctggtggacaagctccgtgagctgaatatcgggctggtggtactggccggcttcctgcacatccttaccggggagatggtggccgccttccccaacgccatcctcaacgtccaccccgccctgatcccctccttctgcggcgctggctactacggcctccacgtccacgaggccgccctggcctacggcgtgaagctcaccggcgctaccgtccacttcgtcaatgaagagcccgacggcggccccatcgtccttcagaaggcggtggagatcctggagggggacacccccgaggtactccagcgccgggtgatggagcaggcggagtggcatatccttccccaggccgtctccctgttctgtgaggggcggctccgggtggagggaaggatcgtccatattttataatttcataggaggtatggagacatgagcgatctgcgtcttctggcatttgtcctcagcggcggttttctgttcctaggcgggatctggcttggcggagactacggtcttgctctgttgctgcttggcttggtcgttctgctggttcctgttgttctggcgtgtatttccctgatccgctggctggtacctcctagccaaagctctcatgagtagtccaggtaggagatgtcttcatatgaaacgaaccgcagtcattgtaatcctatctttgcttgcagcattcgtattttctgcctgcgcgcccgcagcccccagcggtcaaacgcctgaatttttgaatgacatcgggaaaacactcatcgaattaaaaaatgagcatccagaaggcgaaataattgaaagcttagattcatccccagattgtgccgctatatgctttggggagccggaggcggaatatgcttattactttttcggaacgcagagcggcgattctgaaaaggccatgagcgaatgtgaggaacagctgaaatgtgcgggctttgtcaccaccgcaaacatacttttcccagacatggaagatgacatgtcctttgaagattttttctccttgatcggtgtggacgattatgagtatttcggggaagatacgcttgcagcaggttggttaagattcatgtatcaagatatggaagtaatggtgaatacaaacgaaattactcctcgtggcggatgggattttacaggagcagaaatcgtgaagcgtgatgctccggtgtcgattgcagacccagaaatattaaataccaatagtgacctagcgggtgcagttatgttcgatgaaactattttgtgagaacatattgctgcaactggtatgtgcatttctttcccgagggattgtcgaaataatacatccccctgtctgtagacttatttcaagaattcctcacaagtgttacattcagcaaggcaataacaatatgatatcgtagaatggagattatcatgaaaaacctggatcttaccgcgctgctacgcggcaacccctatcccggacgcggcatcgtgctgggcagctcccccgacggggagaagtccgtcattgcctattttatcatgggacgcagcgagaactcccgcaaccgggtcttcgtggagacccctgacggcatccgcacccaggcctttgacccctccaaaatgaccgacccctcccttattatctacgcccctgtgcgggtgttcggcacctccaccatcgtcaccaacggcgaccagaccgacaccatccgcgaggggctggccgcgggcaagacctttgcccaggccctccacacccgaacctttgagcccgacgcccccaactacaccccccgtatctccgggctggtaaaaaagaacggcgactacaccctctccatcctcaagagcgcggacggcgatcccgcctcctgccgccggtatttcttcgcctatgaggccccccgcgccgggcagggccatttcatccacacctacatgggcgacggcacccccctgccctcctttgtgggggaaccggagcaggtggaaatcccctgcggcacccccgcggagcttgccgatctgttgtgggacagcctcaacgcggagaacaaggtctctctctttgtgcgctacatcgaccggaaaaccggagattgggagactgtgatcaaaaacaagcatgcatcagcctgacggacggccgcaggccgccccagatacacacagtccgagggcggcccgcggccgccgctcacttgacggaggtttatcgcaatgacagaactggaactgaaatacggctgcaaccccaaccagaagccggcccgcatctttatggaggagggcgagctgcctatccaggtgctcaacggaaagccgggctacatcaactttctggacgccttcaactcctggcagttggtgaaagaactaaaggaggccaccggcctgcccgccgccgcatccttcaagcacgtctcccccgctggcgccgccgtgggtacccccctcaccgacgtggagcggaaaatctactttgccgaggatatggagctctcccccatcgcctgcgcctatgtccgcgcccggggcgctgaccggctgtgctcctacggcgactgggccgccctctccgatgtgtgcgacgccgacaccgcccgctacctggccctggaggtatccgacggcgtgatcgcccctggctacaccgacgaggccctggccatcctcaaaaccaagcgcaagggcggctataatgtggtgcagatcgacccggactatgcccccaaggccgtggagcacaaggacgtcttcggtatcaccttcgagcagggccgcaacagcttcgccatcaacgaggccctgctggacaacatcgtcaccgacaacaaggagctgcccgagtccgccaagcgggacatgctcatcgccctcatcaccctgaagtacacccagtccaactccgtctgctatgtgaaggacggccaggccatcggcgtgggcgcgggccagcagagccgcatccactgtacccgtctggcggggaacaaagcggacaactggctcctgcggcagcatcccaaggtgctgggcctctccttcgtggacggcatccgccgtcccgaccgggacaacgccatcgacgtctacctctccgacgagtacgaggacgtgctggccgacggcgtgtggcagaacacctttgaaatccggcccgaggtgctcacggcggaggagaaaaaggagtggatcgcccgccagtcgggcgtgaccgtgggctccgacgccttcttccccttcggcgacaatgtggagcgtgcccgcaagagcggcgtacagtacatcgtccagcccggcggctccatccgggacgaccacgtcatcgccacctgcaacaagtacggcatcgtcatggcctttaccgggatgcggctgttccaccactaatggaggcacaccgctacggtctgagcgccgccgctctcaaatgtctggccgcgctgtttatgctggtggatcatatcgggatggtctttcccaccatgctgaccgagctgggcctgcccacctgggcggatgggctgccccggctcatcgggcggctggcctttcccattttcgcctacttcgtggccgagggctgccgccgcacccgcttcttccaccgctatctcatccggctgggagcgtgtgcccttctctcccaggcgcccttcaccctggccaccggcgtctggggcggaagtgtgctcctcaccttcttcctcagcgccggagccatctatggctatgagcgtctgtccaaagcagagcacggcccggccgtgtcggccattcccctgttcgcggcctgtgcgctggcactcctgctcaacgtggactacggcttccccgccgtgctcctgatcttcgccctttacctctgcggtgataatcgccaccgaaagctgctctgtctgggagccggtctggctctcctctatctgctctaccagcccctgatagggctgctctccctcccactgttccggccggactggatggcgggctatctgctccatgccctccctgtgttcgctctctacgcattgtgcgccgaggcatccctccttctgttggcctggtaccgtgggcaattgggtgtgcagagcaagtggttcttttatgtgttctatcccgcgcacctgctgggcctatgggccctggggctggcgctgaattgaggtgtaagcaatgaatgttttgattgtcggcggcggcgggcgggagcacgccatcgcctgggcactgtctaaaagtgagcaagtggaacagctttactgcgctcccggcaacggcggtatcgccgccctggcccagtgtgtccccctctccgccaccgacgtggatggagtggtggcctgggcccagacccattccattgattttgtagtggtggcgccggacgatcccctggccctgggcatggtggatgccctggaggatgcgggcattcccgccttcggcccccgggcggacgccgccatcatcgaggccagcaaaatcttttccaagaatctgatggccaagtaccacattccaaccgcaaagtatcaaacctttacagagctcgcccctgctctggcctacattgaggccgagggcgcgcccatcgtggtgaaggctgacggcctggccctgggcaagggcgttatcgtggcccagacggtagccgaagcccaggaggccgcccgttccatgatggacggccgcaagttcggccaggccggcgccagggtggtcatcgaggagtgtatgaccggcccggaggtcaccgtgttggctttctgcgacggggagcatctggttcccatgccctcctcccaggatcacaagcgggcctttgacggcaaccagggccccaacaccggcggcatgggcgccatctccccctctcccaactacacgcccgaggtggcccgccgctgtatggaggagatcttcctgcccacggtggccgccctcaaggcggagggccgccccttccagggagtgctctactttggcctgatgctcacccccgacggccccaaggtggtggagtacaatgcccgcttcggcgatcccgaatgccaggcggtgctctccctgctggagaccgatctgctggacatcttcctggcctgccgtaacggcactttggaccatctgaacatccggtggaaggacggggcggcctgttgtctggtgctggcctccggcggctaccccggctcctacgccaagggtctgcccatcaccggcctggaggatgccggacagcaggccgtggttttccatgcgggcaccaaactgggagacgacggcacggtgttcaccaacggcggccgggtgctgggcgtcaccgccaccgggccggatctgaacgccgcgatcgacagcgcctacgccgccgcggggcacatccacttccaggacatgcacttccgcaccgacattggccgggtttgaagcccttgcgccccaaggggtgctactgctggttgtcaaattggatgctccggttggttgcgtctatccgggccgttctgctaagatgagcccaaggaaaaaggaggttcatcaccatggaatttcgtgaacggctctaccagctccgcaaagggcggggcatctcccaggaggagctggcccacaccgtaggggtctcccggcaggcggtacagaagtgggaggcgggggccgccaccccggatctcagcaacctgtccgccctggccgactattttgccgtcagtttggactatctggtgcggggaatcgagcccggaaagcccgcagccccttcccctcagcaggctgtcatccaaaactactatagaggctggcgctatgagtaccgcagccgccgcactctcttcggccttcctctggttcatatcaatctgtgtgaccgcagtctgtgtcgggccaagggggtcatcgccatcggcaacgtggccaccggcctgatagccatcggaggcttttccgccggtctgctgaccttgggcggattcagcgccggtctgctggctctgggcggcctcgccgctggggggatctccctcggcggcctgtccgtggtcctgctggctgccttgggcggggcggcattcagcctaggaattgccttcggcggcggcgctgtcagcggctatgcggccctgggcggggcggcggtggggcagtacgccgccgggggcactgcgttcggctccaccctcgctatcggacgggacgcatattcctctgccgccggtctggctctcaccctggagcagcttcacggctactcccccgaggtcctgttccagatgatccacgcccagctccccgaggcccctgagtgggtcgtccgcctgcttctctgcgtttgtccctgaaaaagagcccttgcgcggccgcgcaagggctcttcccttatctgtcttctctgtaagctgaactgtgtccacccgtcccggtgcccctatcatcaccgttgagaaatctccatgtatagaaggggatacggcgctccctgttcatcgcagtctgtccttttatatacacagaatcccatgtgctcataaaaaccctttgcctctgggttctgttcattgaccgtcacgctcttaaccccacaatgcttcatcccatattcaacgagcagccttcccaagccgtttccccgtttgtccggaacgagaaacagcatttcaaggcggccgccatctactcccataaatccgaccggagctccgctttcctctctggcgatgacaagccttggaaccaaattcagcgccccgggaacgtattccttgatctgttctatttcacggctggataaaaagtggtgcgttgccctcacggactgctcccaaattttcagaagctgctggagcaatgcaggctgccgttccttcacttccgctatttccgtatcctcaccccatttgattgcatttccaacatcagcctgccacacaaatgctgcggcttcggtcagccggcttgcttatttctcatccagtgggagtgggtccggtgcacggtgggtcagctcggcacagcaggacttggtcagcttgtccagtccctcatcctggcgggccagctccccggagatctgctccagcgtctgccgcacctggtccagctctccacaggccctggaaaccgccgcgtccatatcagcgcgcaggcggccgtaattcccctgtacccggttcagccactgctccacctcggcccgtgtcttgcggatgcgctcctccgcctccgcctgaaccgcctgggcgcggcagtgggcctccagctcgataccggcggtgcggtccttcaccttctcataggccgccgccgccggcccagccttggccagcttttcctcgctctccttcagccgggcctcggtatcggccaaccgctgcttcgccttctccagctcttcctccagcagggagatctccagcttgcgctcctccgcctccttgtgggcggcggccagctcctcccgcagggcctggagctccttctccttggcctccgtctgggcctgggccgcggcggtctcctccacctgggccgccttggccgcctcggcttccgccagctcccgccggacagcctccagcttctcccggtgctcctggttcgacgtctcaatataattcagcacatcctgcttctgaaacccgccaaaggtggacgtgcggaactgaagttcggtgtcgctcatacggcacaccccttttctacagaatcagagctattttatcacaattcccgctataacacaagcgccacccagaccatagctatctgcacaattctttcttctctctacttgcggttttgcgcaaaatcaactatagttatagttggcattacggcaaaatgtccggtctatcgggcttatccggcggtattctacgttcagaaacatttgagaacggaggtagttttcccatgacctatctggcccacattgccggcgacggccggaaacagacggcggcggagcacctcaacgggacggcggagcgttgcgccctctttgccgctccctttggcgcggaggagctgggtcggctggccggcctgagccacgacctcggaaaatactccatggaatttcagcgccgccttgccggcggccccaaggtggatcacgccaccgccggcgcctttgcctgctggcgtatggggcagcctctggctgcctttgcggcggcggggcaccacggcggcctcccggacggaggcactcagggggattccccggatgccggaaccttttggggacggatgaagcgcgcggaacggggcatgctgcccgactgctccccctggacagaagagatcgccctcccctcccccgctcctcccccctgcggcgcggagccgctgtccctgatgttctttacccggatgctgttttcctgtctgacggacgcggatttcctggacaccgaggcctttatggacggctccccccggccggagcaccccgctcctctggatgacctttgggagcggctccagcgccatatctccggctggtttccccctcagggagagctgaactcccgccgctgcgccgttctggagcagtgtatccggatgggcaaaacccagccccccggcctgtttaccctcaccgtccccaccgggggcggaaagacggtggcctctctggccttcgccctggcccaggctagggccaggggactgcggcggatcatctatgtgatcccctacacctccatcatcgagcagaccgcccaggagttccgaaccatcctgggggcggagaacgtgctggagcaccactccaacgccgcctatgaaatcgacgccgaggccactccaaaaacggtccgcctggcccaggccgcggagaactgggacatgcccgtggtggtgaccacggcggtgcagttctttgaatccctctatgccaaccgcccctcccagtgccgcaagctccacaacctggccggaagcgtcattctcttcgacgaggcccagctgctccccctcccctgcctgcggccctgcgtccacgccatcgcccagctcgttcagcattacggcgcttccgccatcctctgtaccgccacccagcccgcactggggccgctctttgcagagttcctgcccggccgtccggcggtggagctctgtccgccggagctgtgtcccccggaacccttccgccgggtgtgcttccgccaggcgggccggctggactgggacacactgtccggacagctccagcagcacgagcaggtgctctgcgttgtcaacagccgcaagagcgcccaggagatctttacgcggctctccggcgaggggaactttcacctctctaccctcatgtatcccgcccaccggcgcgccaagctggaggagatccgccgccggctcaaggaggggctcccctgccgggtgatctccacctccctgatcgaggccggggtggatgtagactttccagccgtgttccgggaagaggcgggcctggactccatcctccaggccgccggccggtgcaaccgggagggcaaacgccccgtctcggagagcatcgtcacccttttccagggggaggccgccccgccgcctctgtttcagaccgccatcggcgcaggccgcatggtgctggagcagtatgacgacatcgcctcccaggaggcgatccaggcctacttccatacgctcctggagctgaagggggcggaagcgcaggacatatatggtattctgcccaagattcgcacggagctgttccccttccagtccgtggcggagcgcttccacatgatcgacagccccacccggacggtctacatcccattgggcgcgggcgcggagctggtcggacggcttcgggccggagagcggagccggacgctgttccgccagctcggccaatacggcgtatctatctacgaagagcacttcgccgccctggatcaggccggggatctggagcggctggaggatggctcctctatccttgccaccctgtccctctattcggaggaaaccggactgtctctggaggccgactgtggaaagggactgtttatctaaaagaaggtggggaagcttaacgcttccccaccaccccggcgaaatcttttctaaatcaatatttcaatccacgcatttcagcgacatattttagtataacacaaaagcaactatgtttgcaaatcactttttaatttttattgatttagaaaagattatgttgatctatggacagtaacgtgttatattgtgtctagagcagaatgaaaatcagaaaggagtgaacgcctatgtctattcagctggaggtgtggggagactatgccctcttttctcgtatagagttcaaaaccgaacgagtcagctacgatgtcatgaccccctccgccgcccgggggctggtggaggcaatctactggcatcctgggctgaggtggatcatcgaccgcatccatgtgtgcgctcccatccgcttcaccaatctgcggcgcaacgaggtcaagtccactctctccgcccgctcggcccggacggtgatggagcggggcaagggagagctgtatctgtgcacatccgacgacattcagcagcgggccgccctgctgctgcgggatgtgcggtatgtcattgaggcccattttgacatgaccagtcaggccgcccccggagataatccgggcaagtttcaggacattgtcaagcgccgcatcaaaaaggggcagttctaccaccagccctgctttggctgccgtgagtttcccgcccatttccactggtgtgaggagctacccccctgcccgaaggagctgctgggagagcgcgatctgggctggatcctgtgggatatggactatacaaatccggaggatatccgccccctgttcttccgcggcaccctgcgggacggggtgctggaggtgcccgcccgggacagcggggaggtgcggggatgattttgcaggcgttgacccagtattacgaaactctggtgcaggcaggcgtgcttgccggccccggctgggggccggtcaaggcctcctatgcactctctatcgccgcagacgggacgctggagcaggttacgtccattcagacggagcagctccgagggaaaaagactgtgctcgccccccaggtgctcacgctccctgctccggtcaaacgcacagtagggatcgccgccaattttctgtgcgataactccggctacattttgggcgcagacaataagggcaaccctcagcgctcccttgcgtgctttgccgcctgcaaggcgcttcatacctctgttttggggggtgtcgcttccccctccgctcaggccctgctggccttcttccgcacctggatcccggagtatacactggagcatcccgctctggcagagtatcgggaggacatactgtccggggccaatctgctcttccgttataatggaagctatatccacgaagatcccgagattcggcgtgcctgggagcgccgctatcgcgccgataccgacagcccaagaggtatctgcctcgtcaccggcgaggaagggccggtggagtccgttcacccggccatcaggaatgtgtccggcgcccaatccagcggcgcagctctggtctctttcaacgcaccggcgttctgttcctacggcaaggagcagaacctcaacgcccctaccggcaaatacgccgccttcgcctacacggccgcccttaattacctgctggccgaccgggagcacgtctaccggctcggggacgccaccgtcgtctgctgggccagaggcggcggcgacgcctaccaggcctttttcggcggagctctgctgggggcgccgacgccgtacagcgccgcggatctccgcggcatgaccgcacagctgtgccagggaatccccgtggactttcaggaggagaagctcgaccccagcatggatttctatatcctaggcctctcccccaacgccgcccggctgtcagtgcgctttttcctccacaataccttccagggattcctggatcacatccaggcccactatgaccgcctggagatagctcagtccaatgataataaatttgacaacattcctctttggcgccttctgtatgccactgtccgaagtcaaaccaaatatgaaccaagttcatataaggaagcaaaacaaaatttggaaaaatatctccctccagaactatccggtgagatcctccgctctattctcatgaatacccgttaccctgctacattactgaatggtattactttgcgtatccgggcagaacacgaaattacacgaagccgagctgccgccatcaaagcatgtctcttgcaaaattatcgttttcttccaatttattccgcgctaagggaggtattgaccgtggaactaaatgattcttgcaattatcagccctatgttttaggccggttatttgcggtaatggaacaaatacagctcgcctccgcagattggaaattgaaccgcacaatcaaagatagctattttacctccgccgcaacaactcccaaaaatatctacgcaaaattgtttccactaagcgaatatcacatgaaaaagctcctgcgtgataagcccggcctggcaaatatactggggaaggaaaaaggctctctgattggaaaattgactgctcctattcctccgcgttttatgccagaagaaaccgactgtttctatatcggatattatcatcagagcaatcagaaaaaggaggaaaaagagcatgtctgatcctatcaaaaaccgctatgaatttgtcatcctgttcgacgtggagaacggcaatcccaacggggatccggacgcgggcaatatgccccgggtggatccggagactggcctgggcattgtcaccgacgtgtgcctgaagcggaagatccgcaactatgtggagacggtgaaggaggacgccaccggctaccgcatctatgtcaaggacggcgtgcctcttaaccgcagcgacgccgaggcctacgccgcactggacgtggacgaaaaaaccgtcaaggaaaagaaaaaggccgatcccgacctggatcggaaagtccgggactggatgtgcgccaacttctacgatgtgcgcaccttcggcgcggtgatgaccacctttgtgaaggccgctctcaactgcggccaggtgcgggggccggtgcagctgggctttgcccgcagcgtggaacccgccattccccaggagatcaccatcacccgcgtggccatcaccaccgaggccgacgcggagaaaaagggcactgagatggggagaaagtatgtcatcccctatggcctctatcgctgcgagggctacgtctccgccaacctggcccgcaggaccaccggcttctccgaggaggatctgtccctgctgtgggaggcaatcctcaatatgttcgagcacgaccactccgccgcacggggcaagatggccgtgcgggagctgattgtcttccagcacgacagcgagctgggctgcgccccggcctggaagctctttgaagcggtacatgtcacccggagggatcccggtgatcccgcccccgcccgttcctatcaggattactccgtcacggtggacgaggccgccctccccgccggaatcacctgccggcggatggggtgaacttccgtgaggaggagtttctccccctctccggccttcagcactttgccttctgccgccgccagtgggcgctgatccatctggaacagcagtggcaggaaaatctgcgcaccatagagggccagctcttccatgagcgtgcccacgacgcctcccttcgggagcggcggggcgatactctggttctccgcagtctggcggtggcctcccctaccctgggactgtccggccagtgcgacgtggtcgaatttcgcgccgcgccagagggcgtccccctcgcgggcgaggagggccgctggctgccctttcccgtggagtacaagcgcggccggccaaagcctcaccaggcggacgagcttcagctgtgcgcccaggccatgtgtctggaggaaatgctgtgctgccccgtcccggaaggcgcactctactacggcgaaacccgccggcgcactccggtgcgcttctctccagagctgcgccgtcaggttcagtccgccgcagaggagatgcatcagctcttccggcggggccacacccccaaagccaggccgggcaagttctgcggcgcctgttctctgaaggagctgtgcctgccgcagctgatccggcgggagtccgtatccgattatctgaaccgggccatggaggaaacgccatgagacaactgttgaacaccctcttcgtgacctcggaggacatctatctgtccctggacggcgaaaatgtggtcgccagccgggaacatcaggaggccgcccgctacccgctccataccttgagcggcattgtctccttctcctaccccggggcctctcccgccctgatgggcgcctgcgccgagcgcggtatctctctggccttctgcacgccgcgcgggcggtttctggcccggatcgccgggagtacctcgggaaacgtcctgctccggcgtgcccagtaccgcacggcggacgagctctccgccagttgccgcattgcccgcagtatgatcttcggcaaggtctataacgcccgctggagcatcgagcgcacccgaagagatcacgggctccggctggattccgccagcctgacagcctccgcgtctcatctgaaagagcttctcccccaaatcgccgcggccgcctctctcgagcatctgcgcggcctggagggcgccggagcaaccctctattttggtcagttcgaccagctgattttgggtgaaaagcccctcttttcctaccaaagccgcagccgccgtccgccgcgggaccctgtcaacgccctgctctcctttgtctacagtctgctctcgcacgactgcgcctctgcactggagagcgtggggctggattcctacgtgggctttctccaccgggatcgccctggccgggcctctctggccctggatctgatggaggagctgcgcccctgtatggccgaccggttcgttttaaccctgataaacaaccgaatggtggggcggcaggactttgattttctggagaatggggcggtctttttgagcgactccggccgcagatctgttctgaagcgctggcaggagcggaaaaaggagcctctgacccacccctatctccaggaaaagctctcttggggactggttccctatctccaggcgctgcttctggcccgctgcctccgcggcgatctggacgcctatccgccctttttgtggaagtgaggccattatgctggttttgattacctacgatgtcaatacggcggatgccgccgggcgcaaacgcctgcggcagatcgccaggcagtgcgtcaactacggccagcgggttcagaactccgtctttgagtgcaagctggatccggcccagtacaagctgcttcaagccaagctgtgtgcgatcatggatcccgaacgggacagcctccgcttttattccctgggaaatcgctatgagcagaagatcgagcactttggctttaagcagacctaccttccagacgaacctttgattttgtagcgtgcgaagtccaagatgacacgccttctccggccggttcgcacccaaaaagcataaaggaaagcttaatggagcataggcgcgtttgtttttgtatgctcagccttcttccccttgtgcaaataagcaaattgagccaagcaaactctctgctctttggtaaagtttgctgtcgcacccctcgcggggtgcgtggattgaaatagagagtctagggcccaggagcccctggactcttgtcgcacccctcgcggggtgcgtggattgaaataacgtcggagacgttatccccttctatgtggacgaagtcgcacccctcgcggggtgcgtggattgaaatcaacaagactcggaaaacagagttttgaggtaaatgtcgcacccctcgcggggtgcgtggattgaaatctctctatgttaagacttttgatgaaatgccctagtcgcacccctcgcggggtgcgtggattgaaattgtaccatcaattgagtaattgcgtatgaaatcagtcgcacccctcgcggggtgcgtggattgaaattgtaaaaaagtattagacaaattattaacaaaaggtcgcacccctcgcggggtgcgtggattgaaatcacttcttgcatgctggacataataaccaaggaggtcgcacccctcgcggggtgcgtggattgaaatagttttggaatgcagcgaagagatataagctgttccgtcgcacccctcgcggggtgcgtggattgaaatgcctgtccgtcagccgtgcagccatgtcaccacctcgtcgcacccctcgcggggtgcgtggattgaaattggattattatatgggagaccgtatggacgtggctggtcgcacccctcgcggggtgcgtggattgaaatggtttatgcggtatcagtagacgggaatagctacggtcgcacccctcgcggggtgcgtggattgaaatagccacagacgggtctttttctgtactggatgccgtcgcacccctcgcggggtgcgtggattgaaattcgttgagccgcacaacctttccgacctcaaggtcgcacccctcgcggggtgcgtggattgaaatctttggggtatccccaaatacacacccgttgtcgtcgcacccctcgcggggtgcgtggattgaaattataaaaaatggaatgatatggtcaggagatgttagtcgcacccctcgcggggtgcgtggattgaaattggatggtgttgcgggtgtcgcaagcctgggtcgcgtcgcacccctcgcggggtgcgtggattgaaatccgtagtgttgcaaattcgccaacaagaaatttagtcgcacccctcgcggggtgcgtggattgaaattacatttaatcctgcatatgtatctgcactatttgtcgcacccctcgcggggtgcgtggattgaaatcaccctgtacatacttgtcaaacgctggtgctaaggtcgcacccctcgcggggtgcgtggattgaaataatctggcaaatgtaatcaacgccccctgtttgcgtcgcacccctcgcggggtgcgtggattgaaattctggtcattgggcacctccgatgatttcgtccgtcgcacccctcgcggggtgcgtggattgaaatatgagctcgtttccgacggcgcggaggttctccggtcgcacccctcgcggggtgcgtggattgaaatggcgttatgaccctcaaggagagtggcaaagaggagtcgcacccctcgcggggtgcgtggattgaaatagacccgcaagcacaataggcaggggggaaccatgtcgcacccctcgcggggtgcgtggattgaaattcgtaaagcttctggatctggaaggccatacggagtcgcacccctcgcggggtgcgtggattgaaatggaaagataccagaaagcgttatgaccagagaaagtcgcacccctcgcggggtgcgtggattgagattgaacattgaacagaatctgaaccggggcagcgccaggtcgcacccctcgcggggtgcgtggattgaaattgaaagtgcggcctcggcagcgtcgcgggtcaaagtcgcacccctcgcggggtgcgtggattgaaatcagtcggccagggtcaggtcgtcgaagctgacgtgtcgcacccctcgcggggtgcgtggattgaaattcggagctcttatagttgccgcgggcccgtttggtcgcacccctcgcggggtgcgtggattgaaatccttctttgtgcggcagaccaggttacaggacacgcgtcgcacccctcgcggggtgcgtggattgaaatccaggtcaggcggcggaggccgcttcgtgccatgtcgcacccctcgcggggtgcgtggattgaaatacgggcggcctcgtcaatatcatctgtgggccaagtcgcacccctcgcggggtgcgtggattgaaatggagaaggggatcatggccggccgggacgccgatgccgtcgcacccctcgcggggtgcgtggattgaaatccaaagagcggttttttgtcaagacaccgaaaagtcgcacccctcgcggggtgcgtggattgaaattcctctcctttgtccccccagccaaaggcgctttgtcgcacccctcgcggggtgcgtggattgaaattatgacacaatcaccgggaggcccgtcggcaacctgtcgcacccctcgcggggtgcgtggattgaaatggaacgcaggccgagcgagtacacaccaataaggagtcgcacccctcgcggggtgcgtggattgaaatagtgagaaatacgacatcaccaagcatccccggtataagtcgcacccctcacggggtgcgtgggttgaaatcagcggctggaccgcggccacatggagtatgtctgtcgcacccctcgcgggtgcgtggattgaactgtcttacaggggcgcctggtcagtttgcaggagacgccgcataggggcgcgggtcgattcaaattttcaccccgcgcccctgctgtttgcgtttcttttcgttgactggtatagtagggaatgatataataggatgattatgacaaaaactatggtgggaagatcatattatgtggatttcaagtgactggaaggactatgagctgctggactgcggcggcggcgagcgtctggagcgctggggcaagtatctgttggtgcggcccgatcctcaggccatctggcgtccggaggggcggcatcccggatggcggaggcacgacgcccggtaccagcgcgcctccaccggagggggccagtgggtcaagaaggaactgccccagcgctggacattgggttacaaggggctgaccctcaacatcaagcctatgaacttcaagcacaccggcgtctttccggagcaggcggccaactgggatttcgccatggagcgcatccgttccgccgggcggcccatccgggtgctcaacctctttgcctacaccggcgcggcctcggtggcctgcgcggcggcgggagccgccgtgtgccacgtggacgcggccaagggcatggtgagctgggcgcgggagaacgcggcctcctccggcctgtccgacgcgcccatccgctggatcgtggacgactgcgccaagttcgtggagcgggagatccgccggggccgccggtacgatgcagtcatcatggaccccccctcctacggccggggtccctccggcgagatctggaagctggaggagaacctcttcccttttgtggaactggtagccggggtgctctcggacgaacccctgtttttcctcattaactcctatactacggggctagccccctcggtactgacctacctgctggagactctggtagcccgccggtacggcggccgcaccgagagccaggagctgggcctgcccgtcaccgccaccggcctggccctcccctgcggggcttcgggccgctggaccgccgaataaggagtgatgtgctatatgaaccatgcaatcattcaaacagaggggctccgcttcgcctatgcggaggagggggcggtcaacccctttgtgctggacggggtaagcctggacatcgaggagggctccttcgtggctgtgctggggcacaacggctccggcaagtccaccctggccaagcacctgaacgccatcctgctgccctccggcggcaaagtctacgtggacggcatcgacaccgccgacgaggataaactgctggacatccgccgcaccgtgggcatggtattccagaacccggacaaccagatcgttgccaacgtggtggaggaggacgtggccttcgcccctgagaatctgggggtgcccccggcggagatccgccggagggtggacgacgccctcaaggccgtgggcatgtacgagtaccgggagcacgccccccacctgctctccggcggacagaaacagcgggtggccattgccggtgtcatcgctatggcgccccgctgcattgtgctggacgagcccaccgccatgctggaccccatcggccgggcggaggtcatgaagaccatccgtgagctcaaccgctcctccggcgtgacggtagtgctcatcacccaccatatggacgaggccgcccaggccgaccggctggtggtcatggccaagggccgggtggtggccgacggcaccccccggaaggtctttcagcgggtggaggagttgaaggccgtgggcctcactgtccccgagaccaccgagctgctgtggcagctccggcaggcgggggtggacgttcctctggacgcactgagcgacgaggaatgtgcccaggcgctctttgatctgctgcaaacacgggcgtgacctgcgggcatgcaccaaatgataaaggaatgaagccattggaaccgatcattcagacggagcgcctgagccacatctattccgccggcaccccctttgaacacggggccctggtggacgtggactttaccgcctaccgcggggagtacctgggcatcatcggccacaccggctcgggcaaatccaccctcatccagcacctcaacgggctgctcaaacctacctccggccgcgtcctcttcgagggccgggatatctgggagagcaaggagcgcacccgccaaacccgcttccaggtgggactggtgtttcagtacccggagtaccagctctttgaggagaccatctataaggatatcgccttcggccctaaaaacatggggctggacgagagggaggtcgaccgccgggtgcgcgaggccgcccagtttgttgggttgcgtgaggacatgctggaaaaatcccccttcgagctgtccggcggacaaaagcgccgggtcgccatcgccggcgttattgccatggagccctccgtgctcatactggacgagcccaccgccggcctggacccagttggcgtggcgtccatcctgggcaacatccacgactatcacacggccaaaaacgccactatcatcatcgtttcccactccatggaggaagtggcccggacggtggaccggctggtggtgatcaacgacggccggattcccttctccggcgcgccccgggaggtctttgcccacggggacgagctggaggccatgggcttgggcgtgcccgccatgacccgggtgttccaccgcctgcgggccatgggcgtggacatcgacccgtcggtctacaccacggagcaggccagagacgccgtcctggccaagctggcccgtgccggtcagcagaagcagtctgcttccggcgaaaggggggcggtgtaagtggcattgaaggacattaccctgggccagtacttcccaggcaacaccctgcttcaccggctggacccccgcaccaagctgctctttaccgtggcctatatcgtggctctgtttctggccaagcatgtggtgggctatgcggttctcttcgtcctgctggcggtgctgatcgccgtgtccaaggtgggcatcaagagcatcctacgggggatgaagcctattttgatcatcgtcattatcaccggcctgctcaacctgttctacacccggggcgagggagcgccgctggtctccttctggatctttaccatctatccggagggcatctgggcggcggtgtttatggtgctacgcatcgccatgctcatcacctgcaccttcctgctgacctataccacctcccccatcctgctcaccgacggcctggaaaaactgatgggaccgctgaaaaccctccatgtgccggtgcatgagctgtccatgatgatgtccatcgccttgcgcttcatccctaccctcatcgaggagacggataagatcatgtccgctcagaaggcccgcggcgccgacttcgataccggcaacctgctccagaaggccaaagccctggtgcccctgctggtacccctgttcatttctgccttccgccgggccgacgagcttgccattgccatggagtgccgctgctaccacggcggagagggccgcacccgcctgcgccagctcaagctaaagggcatcgacatcgccgctctggtcttcgcggtgcttctgtgtgtcggcatcggcgtgctgcggcactttggactttaagaaaaaaataatgggattttaaagctttatgagaaatattgcgctacgcttgatgtatgtggggacggcctatcacggctggcaggttcaaaagaacgccgtcaccgtggcggagacgctggaacactccctggcctcggtggtgggccacccggtcaaatgtaccggcgcgggccgcactgacgccggcgtgcacgcggagacctatatcgccaatttccgcacctcctcccgtatcccctgcgaccggattcccctggcggtgaacacccggctgcccgatgacatcgtggtgataaaggctaccgaggtgcccgacggcttcaacgccatcggctcctgcctgaaaaaggagtacacttaccgcatctacaattcccacatacggaacgcattttacgtcaaccgcgcctggttctatcccaaacacctggacgagactgtgatgcagcgtgcggcctcccactttgtgggtacccacgacttcgcggctgttcggagcgtcggcaccgaaacccgcaccaccgtgcgcacggttcactactttaatatctcccgcagcggagaactgatcgagtgccgggtgtgcgccgacggctttctctacaacatggtgcgcgccatggtgggcacttgtgtctacgccgccgacggcaaattctcccccgatgacgtgcccgccattctggaaggccgcaaccgcaccgccgccgggcctactgtacccgccggggggctctatatgaccaaactgtggtatcaggaggacgtcctatagctcactctcctgcccttatgtgaactctggaggtatttctatgcctgctgcactgtggttcgccatcggcgccgccatcctctgcgccataacgtcagtctatttgggaacgaaaaaataattctattgcagggcctgcacaagcgccccttttatctgtgccgcttatgcctctgccgcatgaaatccatgaaggagcatagaatggaagaaatcaacggcagccgtcccaacgccgcccccaaacccaaaaagcgccccaaccgttttgtccggttcctggcctttctggtgacactggccctgatggtgggcgcggtcgccctggtggccaactatgacaagctgaattttgacttcatcaagcgctggttctcctaccgcaccttggcgcgcaacgacagcggacaggcggagtcctttcattttgttggggactcctccaacgcctttgccgtcgtggacggagatcttctggtctgctcccccaacaccatccggctgtattcgggcagcggtcaggcctttgtggatcaggccgtttccatgacaaatcctgtggtcagcaccgcaggcggcaccgctctggtctatgatgccggcggccgggagctctttgtctactccggtcgggaggaggtcttttccctcacccaagaggacggccaggccctcctgtccgccgatgtgaaccagaacggctggctggccgtcaccagccaggagagcgggcacaagggctcagtgacggtctacgacaacagctacagtcctctggtgcgcttcagcctgtccaaccgttttgtgatggacgccgccgttgccccggacaacaaatcggtggctctgctcaccatcggccttacggacggtaattttgagagccgggtggacctctatcgcctggaccgcacggaggaggaaacggagccggactggacctgcccggtgggcaacaacgcgattcttgatctgcgctggaccagcagcggcatttgggccctgggtgagtccgggctctatattgtctccggggacggcgtgctctccggctcctacgactacggggggcgctacctgaaggccttttccctggacggggacggcaccgcctccctcctgctggggaaataccgggcgggcagtacggcggagctgctcaccataaacgcttcaggtgagctggccgctgccctccccgtagaggagcaggtactctctctctccgctgccgggcggtatgtcggcgtactcaccgccgaccggctggatatctacagccaggatctggagctctataacaccctgaacggcacacagaacgcacaaaaggttttacagcgctccgacggcagcgccatgctcattgacagcaccaccgcccgcctctatgtccctcaataaattcggaggaaaaccctatggcttatctgattgctgacggcctgattctggccgtgctgctgctcttcgccctggtgggcgcccaccgggggttcatcctgtccctgtgcggtctgctggccgtgctggtggcttttgtgggcgccagcttcgccgcccgcactctctctcctatggtggcggatgccttagagcccaaattcgcctcggccatcgaggaacagctcaacgcctccatccagcagcaagtggcggaggagggctccgctgccctgtcccccgacgacgtgcctctggacggggtactgaacgccctgcgggagatgggcttttatgaaaccctgatcaacaccgtggacaaggccgtggagaacggaatgacctccgtggccgcgagcgcggccgccgcagttgcggctgccatcgcccagtccgccgcctacctgatcctctttctgctgggcttcgccctcattctcattgcctggaagttgatcagccatgccctggatctggtggcgcggctgcccggactacatttcctgaacaagacctgcggcgcgctgtttggcctggtgcaggcctgcgtccttctgtttgtggcggcctggctgctgcaattcttcgggcacgtactgcctgagtccctggtaaaccaaacccacctgctgaaattcttcatgactaccaatcccctctccctgctcagcggcctgtaatcccgccctaaaccaaagaaaatcaggtgaagctcctatgtccatcccaaaccttctctccctcctccggctagtactggtgccggtctttgccgtcgtcttctttcagcccgctccagacgctcatcgctgggcggtgctgatctatttaaccgccttcctcaccgatgtagctgacggctggatcgcccggcacttcaaccagatcaccaagctggggcggattctggaccctctggcggacaagctgatgacctttacggtcattatctgcatcaccgccgacggcatcatccctctgtgggcggtcgtcgtctttttcctaaaagagctgaccatggccatcggcggctatctcatgtaccagaaactgggtgatgtgatctcctccaactggctgggcaagacctccaccggcgtctttttcgtggtctgcgccgcgctggtgctcttccctgccatcccacgcccctgggccactggactgatctcctttgccctggccctcactctggccgccctgtgcagttatatcttccagtaccggaaggctttaaagaaaagaaaacaggcgtgattcatacgcagttcataatttcgaattagaatcatttctctgaggggactattctcccctccaaaggagctgaatacaaatgcaacccacactttgttccagatgccataaaaatgtggccgtgatctttatccagaagatggagggcgggaccaccaaaagcgagggcctctgcctcaagtgcgcgaaggaaatgggcatcaagcccgtggaagatatgatgcagaagatgggcatcagtgacgaggatctggagggcctgaccaatgagatgatgtccgccttcggcggcgccgagggcatggagggcctgatgtccgcggaggaggccgacgaagacgaggaggacgagggcaaaaccgccaccttccccttcctcaacaagctctttggctcggctcaaagcccccaggcccagccccctgagcgggagcagccccgcgccgagcgcggagacaaggacaagaagggcgaaaagcagcccaagcgcaagtttttggagaattactgcatctccctgactcagaaggccgctgacggcaagctggaccgcatcatcggccgggacgaggagatccagcgcaccatccagatcctcaaccgccgccagaagaacaacccctgtctgatcggtgagcccggcgtgggcaagaccgccattgcggaggggctggcccagaagatctaccagcgggacgtaccctacaagctgctggacaaggaggtctacctgctggatctcaccgccctggtggcgggcacccagttccgcggccaatttgagagccgcatgaagggtctcatcgaggagatcaagaagctgggcaacatcatcctggtcatcgacgaggtgcacaacatcgtgggcgccggcgacgccgagggctccatgaacgccgccaacattctcaagcccgccctgagccggggcgagattcaggtcattggcgccaccactctcaccgagtaccgcaagtacattgagaaggactccgccctggagcggcgtttccagcctgtcatggtggaggagccctccatcgacgactccatcaggatcattcagggtatcgccccttactacgagaagtaccaccttgtctccatctcccccgagatgtgccgcctggccgtgaccatgagcgagcggtacatcaccgaccgtttcctgcccgacaaggccatcgacctcattgacgaggcctgctccgacgtcaacctccacaacaagaccttggcccgggaggtggaggtgaaaaaggagctggatgccctggaaaaagagcgggaaaacctgatggtggaggccaacgaccgggactacaagcggcagaccaccctcaagaacaatgagcagcggcagaccgagatccgccgggagctgaacaagctgaccgccgagcacgactctctcatgggtaaccccgccaccaccgaagccctggcggccaacgagcagcggcagtccaacttccgtcgggagctggacaacctggccggagagcgggagaagctcctctccgacgagggcagcagccgtgactatgagcggctggcctccatcaagagccgggagatccagcttcaggacgagctgaacaagctggaggcccagagcgccccccctctgacggtagagcatctggcccgtgtgatcgagctttggaccaagatccccgccagccagatccaggaggccgagtatgagcgcctggccaagctggaagaccggctgaaggagcacctcatcggtcaggacgaggcggttcacgccgtggccgccgctgtccgccgtggccgggtgggcatcgcctccaagcgcaagcccgtgtccttcatctttgtgggctccaccggcgtgggcaagaccgagctggtcaagcggctggccatggacatgttccactcccccgaatccctcatccgactggacatgagcgagttcatggagaagttcgccgtcagccgcatcatcggctctcccccaggctatgtgggctacgacgaggcgggccagctcaccgaaaaggtgcgccgcaagccttactgcgtcattctgtttgacgagattgagaaggcccaccccgacgtgctcaacattctgcttcagattctggatgacggccacatcaccgatgcccagggccgaaacgtgaacttcgaaaacacggttattgtcatgacctccaacgcgggcagcgatgcccgtacctccgccggttccgtaggcttcggccgcaccgccgaccagcagggcagggagcgggccatgaaggccctggaatccttcctgcggcccgagttcatcaaccgcgtggacgagatcgtctacttcaacaagctcaccgaggacaacttcaaggccattgccgccattatgctccgtgagctccaggacgcgctgaaggagaagggcatcaccttcacctgggacgacgcgctgctggactacctggtgaagaagtcctactccatgacctacggcgcccgcaatctgcgccgccagattcagaaggatctggaggacgacatcgccaccaagctcatcgacagctacctccatcccatccagagcatccatgcctccgccgacggagagcacccggtgctcaccgccgaataaatccaaaaaagcgccccggccgcagccggggcgcttttttgattatgcgttgaccttggtgatagaggccagtagcaggcgggtgccgtgctggagaaactcctcccgggacagaccgatggtcttctgaatatatccctcccggatatcggcggtatgcaccatgccggacagggcggaccagaacagcagaaccgtctccatagggggaagctgagagcgcaccgcgccctccgccgcaccgcgtaccaggaaggccgccagctcctcgtcgatctcactgctcacgcgcaggatatccgcaactcccttctgagtctcgtccgcctcctgcaccagaggcatcgtgcccgtagcggcatcataagcggtgggattttcatcgtagaaccggacgatggagcggcataccgcgtcgtaggcctgataccagtcgctgtggctctcaatggcctcgtgaatcttctttttcaacagaaccataccgctgaggagaatggcattgatgatctcctccttgctctgaaagtacacatagagggtggccttgctgtactccgcctcccgcgcgatgtcatccatcgtcgtcttttcggtacccttctcggcaaatagccgctcggcggccgctagaatagagccccggtgaaactccgtcagcgcctgcttcttactcatcacgtcattccagcctttccaattcaacaatcaaacttctggtttaggaaatgatatcatgattttcgttctattgcaagcagattttcaaattttcagttagaagaaagaaaaaatcaccgagataattatatcgaactatgccgaaaatgcaacccttaatttttgcctctcctctgtaaaattctcttgccaaaccgggaaagatatgctatacttttttagtcgactgaattgcagggttagtacatcggtagtgcatcggcttcccaagccgagaaggcgggttcgactcccgtaccctgctccacatcggagcaagctttgtatcgcttgctccgatttttttataagtcagagcaagctcacgccgctgtgcggcggtttcgttaaggggaaatatcaattttaaccgccccttccacaaaagaaggacatctgtaagatgtccttctttttgcgtctcggccgcacgaagcgtccaccggtcttttgcccaaacgaagcagcctccgccctcccttgcagtaacttttttcctcagaaaagagcaggccgggtgtctgcttccaacacccggccgccctcataggaaagaagaggatacaatgaaaaagactctgtctcttgcaaggagtagaatacccgtttcatgttacaaaagcatgcaaaaatcgttacgggagtattaaatcttgacggagcctccccaaaagcgtatcatagctgcataaggacaatggaggaatttggtatggcaaaaaaagttctgccggctgtgctggcgctcattctgctcctctccgcatgcgggagcaggcttccttcccccaccggcaccccggcacaccaggagccctctcccactgtggcccccacaccggagtccaccccctacgacggaccggtcagccccttaagcggcctgcctatgggcaaagaatgggtcaaccgccgcccggtggccatcatgctcaacaatctgaaagaggcccttccccagcttggtcagtcccaagctgacgtgatctacgaagtaccggccgagggcggcatcacccgcatgctggccgtctaccagtccttggacggtgttgggaaaatcggctccatccgctccgcccgcccctactatctggagctggccctgggacacgatgccatctacattcacgccggcggcagcgaggatgcctacgccaaaatccgccaatggggcgtcaccgccctcgacggagttaatggcccctacatgagcaacagcgagaacggaaatctgatgtggcgggacccggagcggcgtaagagctacagtctggagcacaccgtcgtcaccaccgggacctccatcatcgagcgtctgcccacctacggcctccgtctggagcacgaggacggctaccgttgtcagatgaactttgtggaggatggcaccccggccggcggcgctgaggccccgcggatcaccgtccctgtctcccactataaaaccggtgtatttacctacgatcccgacagccggctctaccgggtggaggagtatggagagccctatgtagacggcgacagcggtgaacaggtggccgtcaccaatgtgatagtcctcaagaccgcctgccgttataccggcgacagtctgggccacatcactgtggacctgtccagcggcgggacgggctacttcgcctgcggcggcaaggtcattgacctcacgtggagcaaggacttccccgacggccagctccaatactatgacctgagcggctcccccatctccttcggtgtggggcgcacctatgttgtcatcgtccccctggattgcgcggtctcctttgaataaagtcagagggcccgctgaggcggtcaacaagccctcctgctaaagcgttcggagggaaggatagtatgaaagggaaccgccagggttccctttcatgtttgatcaaacgactttttgaaacgctttcagagtttcaaaaagtccagcagcccgtcggaaaggactttccgacaggctgcgcgggccctctggaacattccagagggcccgcttttgttcagccgcagcagcccttcagctcccggcaggtttccgggatgggcgcggggctgttgggcgggaagaactcgttgaccgggaacttcacgtggcggaagatctcgcagggatcgtcctcgcagccgccgcaggtgcactccttctccggcatacagtagtcatataccggcatcaggagctgggagtcccgctccagacggatgatcgagaactggcccagggtaacatagatccgctttccgtcattgccgaagcacaggtcgcagccgaagcaggcgcaaatgcacggcgggatttcggtcagttcacagtcgcaggggcggcactcgcagacgtccaccagcttcatattgagcacgatggggtctaccgcctccaccacggcggtgggcaggttggttttgccgatgttctgctcatccatcccctcaaacgccacctcggaggagaacaccttggcggtgccctcgctgccgaagagaatcacccgcttgtcaaagacacacaggccgcagacctccacaggccgggccgcgccgatgaacgcgtccgcagtcacgcggtagtagtagcggacatccacagtgtagaagccccggttaaagccgatgggttccacatcaatgtacacgtacagcagctccgccttgcccgccttgatgctgatggcgcggtcgatcaccgcctggcagttctgggtggggtaaaagcgcaaatcctcgatacaatccttgtctttgcaagaatcatagatcttcttcgtgtgtatgcacacggcctcgcggatacaggcagtatcctgcaccggaccgggcatgaccttctcaggcattgcaatacctcctagcagagtattcaaaaggcccttccttccccgctctattctatgaaccaccgcccatttggtgcggaggcggagcggcgggccggaatgaaaaagggacccaggccattctatggcccgggtcccaaagccgtgacactcagcgcggcaacactgtcttcttctttcttctgtgggcagacagcagatcccctgcaatcagcgctccgcaggcggacagcagtaccgccccgatcaggagggcgcagttgaggaaaaagcgctccggcatgatcagaatgatttcatccgtggcaggattaaacagccagttgtctttgccgggaaaaaagaccgcatgaaagacggtaaaggcccggctgaagtccagcgccgccagagcgcccaccgccagtaccagaccggcggccagcacccccgcccaaaaccccggtcctcggcccactgggcggtaaaactccagccggtgcagccgcctcaggaggaggagcaacgccgcagacacagccgtgacgcccaaaactaaaaagtccgcccgaaagagcacccggacatctgcaaagtggctccgccccgactccgaccaggacagctccccggtcccaaagggcgttccgagaacgcagaagtccagcacctcgtcgtaggcctcccgtatgacctcctccggccatccggtacgctcaggcaggcggagggcatcgatctgtatatagtaaaagggccggaacaggatcggcaccgcaatggatgcgctgagcaccagcagggccagaatgaccgtcaaagccgctgtggccagtttggaggaacgcatttacagtcacttctttctcacagaaagggttatcagcacctgagagggcaggtaaaagagccacatgcccacctgggcaaaggaaaagagcggtccggtatcgaccaccggcaggaaggccgccagattgtgcaggcccacgcagaggtcacagcccacaaagagcagcagccccagcccgaagcaccgcccccgtcgccccagacgcagggcggacaccgtgttgcaggccagctccgcgaaataacaaagggtcacagccgtcagcggctccagcgccctcaggagcgccgcaaccgccagggccgcaaccgtcagccccacgcgcagcggccacagcaggccagcgccccagcggtgcaggcgcagcaggtaaatcgcctgtaccacacagaagcaggccacccccgccaggtagaaggaatcaaggatcaggagaaaccaatccgctgccagcgtaaaggccagcgcggcgcacaccaggcgcccgtcctccgttccggcccggtccaaggccgccaagaagcacagagccaccgccccgtatttcagcaggagggcccagccgctccccggccggagcagatccagcgccagaaatccgagataaagcgccgcctccgccccgaggaagcatccggtctttatgcgccccgccaaatcccgtcccccctcccatatgaaaagcattatacaacggcgggccgcgcttgacaagaagcacggcccgccgtccggtgtatttatcgcttgaaccgctctagaagcgcggcctcccaacggtctccatatttcaggcagacggcgaagacggccactccggcggctcccagcagaagcatcgcccacacgggaattgtgagcaccgagccgcccaacgcacaggccaccagaaggccccagggccgtgtgagcagtacgatcaggaaaaagcggtgcagcgggatgtcggtcagccccgccagaatgcagatcaggtcgtccgggaaaaagggaaagagaaagacaagaatcaaaaagatatcccgcttcctgcgtataacctccaggtacttgtccgccacccgttggttgaccagccgctccacaaaccgctgccccagtacacgggccagccagaacacaaggacggaaccgcccgccactgccaaccaggtcatcaggaatgagggccacattccaaagagcaccgccccagccagcgccgtcacgttgctgggaatgggtgcgatcaccaccgagagcagttgaatcaggaaaaagaacaggtgggaatagggcgcaaagcgttctatataatttcgcatctcctccaacgagccaacggaggaaaaaaagcccgtctgccaaagcaggaacgccccgccgcccaacaggaacacagccaggagcagggtcagcagccatttatgtcgtttcatgtcggtctgtcgcctcaccaatcgaattgtctataggctaccacgttttggctctctatgccagaggaaattccttaagatttctttataaaaacaaaaaacccacaccaataggtgtggtttctgcctcaggaccctttaccgctcgctgtaaatcacctggtcgtcgctgccaaagatgaggtcatccacgtcggaagcgccgatgctgttgtaccataccatactgtaccagcctcctttctttgattgataattttagtatatacgctcttgggggaaaatgcaagccgtcaattataaactttacacaaaattcacatattaattttggctgatccgtcactctcctccgccaaatggccgacgcgatagagtatggagttttcgccggcgggtacgcccccccaatatcagcgccaaagatttgcgggaataaaaaatcccgaagtctttaccggtaaagacttcgggatttggcgcagaaggagggatttgaaccctcgcgacggtttcccgccctactcccttagcaggggagccccttcggccacttgggtacttctgcatgccaaatacaggatacatttggaaaaaatgtggcggagagagtgggattcgaacccacggatgcttccacatcgccggttttcaagaccggttccttcaaccactcggacatctctccacgtccggtctccggccaaatgcaaaaaagatgataccacacttttcgcacattgtcaactgccgcctgcaatatttttctgctttttttccaaactcagccttgacttggagcggagtccaggtgataaaatcgaacaaacagcgggagccagcccgccggaaggagcagatgaccttatgaccattgccgaagtcagccgtaaatacaacctctcagccgataccctgcggtattacgagcgcatcggcctgattcccaccgttcaccgcagcaagagcggcatccgggattataccgtggaggactgcgcctgggtggagtttgccaagtgtatgcggggagccggtatccaggtggaggctctgatcgagtatgtttccctgtttcagcagggggaggataccaccgaggcccgcaaacagatcctcattgagcagagggagctgctgctggagcggatggaggagatgcggcagacgctggagcgccttaactccaaaattgaccgctacgagcagacggtcgctgtcgccgaacagaaactgcgccgcgagtaagggaggcacaccgctcccttctttttatccgctgcacggggagcagaaacgtaaagccccggtaaaggttagggaaagctttggaaaggtgccttgtagcttggcgcggcgggtgctatactgccccctggttccatggaaccaaaaccaaactgcaaaggaagtaggaaagcatgcagaaacgcaacaaggtcctggccggcgtcctcaccggcgcgctggtcctgagcgccggccccatggccctggccgccacggccaattataacgacagcagcgtcaccggaggctctgccgcctggcaggactgggtcaaggagtgggagaccgtagccgccgactacaccaaggtatccctcacccccggcgcagacgaaacccagctcaacttcgcctggtacagcaagacggagagcggcaaggccgccacgccggtggttcacttcggcaccgacaaggaccacctgaccgccttcactggcaaggccgcccaggtggacgacagcctgaccgacggcgtggcctacgactataaccatgtcaccgtcaccgggctggaggccaacaccacctattactataccgtggagaagaacggcgtacagagcgaggtacaggagtacaagaccggcagcttcgactccgtaaagatgctctatgtaggcgacccccagatcggcgcctccaagggtcagccccagaacggcgaggccctgacggccggctccggcgcggccaacaccgccgcccgcaacgacgccttcgcctggaaccgcaccctggagatcgccactgcccagaaccccggcgtcaacttcatcatctccgccggcgaccaggtcaataagaccggccaggccaaggaggaggagtacgcgggctacctctcccccgccgtgctggccgggctgcccgtggccaccaccatcggcaaccacgactccctgaaccccgactacacctaccacttcaacaaccccaacgccaccgagaacggcaagacccaggccggcggcgactactactactcttacggcgccggcctgtttatcgtgctcaacaccaacaattacaatgtagccgagcacgagaagaccatccaggaggccattgcctctgctcccgacgccgcctggcgcgtggtcaccatccaccaggatatctacggcaccggtctggatcactccgacaccgacggcatgatcctccgcacacagctcacccccatctttgacaagtacgacatcgatgtggtgctccagggccacgaccacacctacagccgctccaagctcctctacggcgacggccagacccacggcacctatgagttccgtctgaatgcggacggcagcgactacgactgggacaacgccttcaacacccagaccgacgagaaaatccccctgtaccccgaggagggcgacaccgccagcacggccctccacgacgccttccaggcggacaacggctgctacaccatcgaggacaccaccggaaacaccgtggtcaatcccaagggcaccctttacatgaccgccaactcggcctccggctccaaattctacgagctgatccccacccagcaggactatatcgccgagcgcagccagaactggctgcccagctactcagtcatcgacatggacagcgacagcttctccatcaccacctaccagatcactgccgaaggcaaggtggaggcgattgacgacaccttcaccatccagaagaccgacggcgccgccaccctgactgagggcggcgagacctactaccgcctgcgggacgtggccgccgcggtctccggccaggacaaccagttcaatgtgagctgggacaacggcgtggtgattaccaccggcgcggcctacgccgacgccgtgcccgccggcacccctgccagcggcagcgccgtgaccctcaccctgaccgtggacggcaagagcgtcaccacccccgccgttctggccaacgggagctactacctgcccgcctccttctatggcactctgggcgtgactccggccgcctgagcggccccatccggcaccgatactgcgaggctcccggcggcatagctgccgggagcctccattctgagagaaaggctgactgctgttgaatatcaaatcctgctttctgcgctggggcattccgctgttgctgctggctgcatttctcgccgctgttttcgccctcaaccgggtggacaaggtggccctggtcaaccgggaaggacagaccttcgagaagggcgtggtcgtggacattctccaggacaacctcatgcccgacggctcccgggtgggcgaacagcgggtactggtacgcatgaccaccggcgtccgggccggtcaggagctggagaccaccagcgcctccggcttcctcttcggcgcgggctgcaccgtgggcatgaaggtggtggtcatgcagagcgtggcgggggactccaccatcaccagcatctattcccaggatcgggagtgggtgatctacgccttcgccgcagcctatctgctggtgctctgcctggtgggcggaaagcagggcctcaagggcgccctcggcctggtgttcaccttcttctgcattctatttgtctatctgcccctggtctaccgcggttggtcgcccttctgggtggcggtgctcatctgtatcgtcaccacgctggtcacgatgtacctcatcggcggccccacccggaaaaccgtggtggccgccggcggcacggtggcgggcgtggtgattgccggactggcggccaccctgttcagcctggccaccggcatcacgggctggaacgtgtcggacatcgagagcctgctcaccctggccagcaccagcgggattcaggtgggcggcctgctcttctccggcctgctgatctccagcctgggcgcggtgatggatgtggccatgtccatcgccagcgccatcgccgaaattcacgttcagaaccccgccctctcccgccgggcgctgttccgggccgggatgcacgtggggcgggacatgatgggtaccgactccaacaccctgattctcgcctttgccggcggaagcatctccatgctggtgctggattacgcctataacctcccctaccggcagatcatcaactccaacaacatcggcatcgccatcatgcagggcctgtccggcagcttcggcatcgtcctggccgtccccgtcaccgtggccttggccgttctgctctatacctggcgcaaagctgcgcccgcggcataaagcgaccggatgcgacacgctccccgccctatactgggccggggagcgtgatttttatgcagtcctttttccggcggctggcggcctgcgccgccctgttctgtgccaatccgctggcctttctccgggggctgtccgatcccgacagccctgtgcgccgcctgctgcggcgcaaatagcagggagggcgcgccgcagcgcgccctccctgtattaccgctcataggtcagccacgtctctccctcgccgctcttgcggtagatgtgggagaccgccgcctcccggatctcatcgcaggcccagtggcccttctccacgtcggtaaagggcagggccgcggcccgctcccccgcccggcgatccagggcatggttgaggatcttgaccgcctccgcccggctcaccggcgcgtcgggccggaaggtgccgtccggatagcccgacacccagccctcctccgccgcaaaagagaccacctccgccgcccagtggccgtccggcacatcggggaacggggacgtaccgccctccaccgtaaaataggaggcgatcagcttgaccagctcggcccggctcaccggctgctccggccggaaggtgccgtcgagatagccatttgcgatgccgtagcgcttggcaaaggccacatagggggcgtaccagtccccccgcttcacatcggaaaagccgccggtaccaggcgctccgctgtaaagcagattcccttgctcgtctacactgaggcgggccagcatggccaccgcctcggcccggctcagggagtcctccgggcggaaccggccgtcatttccctggatgtaggcgtcgtgctccctggtgttcagataggccggctccgccggctcctgcgactcctcgccataggcctccgcatagagcgccagcagctccgggttttccgccatcagccggtagcggaagtgcgcctcccccgcgacctggggcagggtgtcgttgagggccagttgtcgctcgatggctgtcgtgccgtaccaggggctcttgggatcgctgttgccggccagatagtcggccattcctatgtaaagggaaacacctgtaccctttaccgtatccgcccaccagcgggccaccgtggcgtagtccatgctcttgtggccgatgtaccagtagatctgggggcagatgtagtcgatccacccctccttgacccatttccggctgtcggcgtaggaggcgtagtagctctcatagccgccggtggtattggagccctggggcaggctgctcttatccgcccacacgccggaggggctgatgccgtaggacagccccggatcaatggcgtggatgcgctcccccagtgtcttgaccagctggttgacattgtcccggcgccagtcgccgatgttggaaaagcccttgccgtacttggcataggcggccccgtcggcaaagccgctgccggggtagaagtagtcgtccaggtgaatgccgtcgatgtcatacttgcgggccagctcctccgccccccgcacgatgtactcccgcacctcgggcaggccgggattgaagtagtagtcgccctcatactccaccacccagtcggggtggagctttgcggggtggtcggcggtcagggcctggaactccgccgcgccccccttggtgatgcggaagggattgacccaggcgtggagctccagccccagggcgtgggcccgctccacccagtaggccagcggatcaaatccgtttttcggggcggtcccctgtgcgccggtgaggtatttgctccacgggtacagctcggagggatagagggcgtcggcggagggccgcacctggagaatcacggcgttcatgcccatgtccacacatccctgtaaaatcgcgtcggcgtcccgcttgaggaccgctggatctgtagtggcctgactggggtagtccaggcggtacaccgtggccacccaaacagcccggaactcgtccgcccgctccgcttgggccgccgccgcgggagactgcgccgccagtcccagccccgccagcgccagcgcgcagatgagtgcaattgccaacaggggtttccagaattttgtcatgaggtcgctcctttgaatttggtctcgtgaatctgctctcggaatggcgggcgcgccctgcgccccctactgattggaaatctgctccgccaggtcgttcaggtagacccagcgctccattttctcctccagggctgcctccagctcagcctgccgctcctggagggactggagggccacatagtcggtggccttctcctcctgctcggcctgcacctgggccagctcggcctccagggcggcgatgtcggcgtcaatggtctcaaattcccgctgctccttgtagctgaatttcaactttttggccccctgggggcgcgctgccttgggttcggcgggcttgggggatctggccggctgtccagcggcccgccgggcctccagatactccgtatacccgccgggataaccccggacgcttccgtccccctccacggcgaacacccgccgcaccacccggtccaggaaatagcggtcgtgggacaccgccaccaccgcgccggggaaggagtccagatagtcctccagcacgctgagggtctgaatatccagatcgttggtcggctcgtccagcagcagcacgttgggggcggcggccaggacggacagcaggaagagccgccgcttctcaccgccggacagcttgcggatggggctccactgcacctctgccggaaagaggaactgctccagcagttgggaggcggtgagcatccccgctcccgtctcgatgcggctgccgatctccttcacatagtcgatcacccgggtatccccgtccatatcgggcacctcctggcggaagtagccgatgcggacggtctcccccgtctcgaccgccccggcgtcgggggccagctccccggccagcaggttgaggagggtagacttgccgctgccgttggcccccacaatgccgatgcggtcgtcccgcaggagcatgcagtcgaagtcccgcaccacggtgcgtccgccgaagcccttggtcacgcctctgcactcgatggtcttcttacctagacggctggcccgcgcgtttagttccaaggtacttttttccgccgggccgctctgggccttcagggcctcgtagcgctccagccgctcccggctcttggtcccccgggcggtaggcccctgcatcacccactggtactcccgccgcaggatggcctgccgcttgcgctcgctggcccgctcgctctccagccgggcggccttgcgctccagatacttgtcgtagttgccctcgtgggtgaacaggcggccgtcctccacctccgccatgcggcccacgatgcgctccagaaaataccggtcgtgggtcaccatgaccagcgcccccttccaggcgcgcagatagtcttccagccagagcaccatgtcgttgtccaggtggttggttggctcgtccagaatcagcacgtcgcaggggcgggccagcaccgccgccagggccacccggcggcgctccccgccggagaggtttcccacgctctgctcgaaccgggatactcccagacggttgaggatggttctggcctcatactccgccagagagcggtcggcgtcattcagccccagcagcacctgctccagtacggtgcgctccccctgaaacaccgggttctggggcaggtactccatccgcacgccggggtccaggcgtaccgtccccccgtccggctcctccgcccccgccagcaggcggaggagggtggacttgccggcgccgttgacgccgatgatccccaccttgtccccccgctccagataaaaggacaccccgtccagcaggacacggtcgccgtagctcttggtcagttgttccgcagaaagcagcatgaacgtccctcgcttttgtcaagttatctctcagtatagcggaatctgcgaaaaaaagaaagccccctccggccggggcctgtttccgaattgcttccgaaatgtcccgcggggattgccaaccgctcggggatgccgtatactgggggcacaactgaatcgagatgtcttcagggcagggtgaaattcccgattggcggtacagtccgcgcgcgtgatacgcatgatttggtgcaattccaaaaccaacagtgacagtctggatgaaagaagataccatcggtttccgcaggacggccccgccgttttgcggccgattcctctttttcgcaccggaaaggcatccccttttcggtgtgattttttaggagggaacggaagtatgaatgtcaaagcaaagaggatcaccaccatcgccatgctgtgcgcgctcgcctatgtggtcatggtcgtcggccgcgtgccggtcgtgctctttttgaagtacgatccgaaggacgtggtcatcaccctcggcggcctgatctgggggccgatgaccgcctgccttgtctcggttctcgtctccgttctggagatgttcaccgtcagcgacacgggcattctgggctgtatcatgaacattctgtccacctgcgcctttgcctgtaccgcctccgccatctaccggaaaaagcgcacgctggccggggctgtcgccgggttggccgccggatgcgcggtgatggtcagcgccatgctgctgtggaattacctcattacgcccctctacatgggatacccccgggaggcggttgcggagctgctgctccccgcctttctccccttcaatctgctcaagagcggactcaatgcgggcatcaccttcctgctctacaagccagtggtctcctctctgcggaaaagcggactgattgacgcgccgtccggaccggcggcgcgcaggcccgtcgggctattgcttctggccgccgttctggtggccacctgcgtcctcattctcctggccagaaacggacttctctgaggcggcccatggacaaggcaaacggggacgcccccttcatccccctgtacggaaccgccgtgcccggcgccgggctgggacggctggcggggctgcccgccgcgggcctgcgcctgcaccggggacaggcggcgccggaacccggcgtctacgccgcggagatccttctgggcggccgccgcctctgcggcctggcgcatatcgcgcccggcggcggcgcgccctccattgagcttctcttctttcacggtggggaagcgccctgcggggaggcggtggagctgcgcctccgccaaaggctccgccgctgtcagccctttgacaacctgcccctgctgtcggcacagctccggctggattgcctctccgcccagtccttttgggggatttcccccggctccccccggctgtccatggagtccgcagggcggcgggcggtggtagggatgcaggcaatccccctgtctgaaaaggagtttggtgtcctctacctgctctatacccacccggacgttccgatcacaaaagagcagatctatgaggccgtttggtgcgcgccgtccaaccactgcctccacgccgtggagaacaccgtgtttcagatccggaggcggctccgcccccatgcgggcgggcacgacttcatccgcaccgttgtagggctcggctatcagttcaatcccggctgagccgcctccctgtgcagccgccgggacaaaagctcttggcaaacgggaaaaaatatggtatcctaaggcgctatcccattgtgaaggagcctttatgagacagcgcatattcccgatcctggccgtcctccttctggccgccgccctgcccggctgtcaggacgcggccgccggagaccgtgccggactgttcatccacttcatcgacccggagcagaccagctccgccctgcttttgtgcggcgggcaggccatgctcattgacggcggcggcacccagtggggcagccaggtggccggttatctcagccaacaggggatcacctacctcgactatgtggtatgtacctctgcggacgagccccacatgggcggcctttccggcccgctctatacctgcgtcgtggggcaggtgctctccccggtggaggacgccggaggcccggtgtttgccgatttccggcgctataccgaggcccagggcctctcccccgccgtcccggaggccggtacggtatttcccctgggggacgcccaggtgacggtagtggagaccgacgccgccgcacagacgctctccctccaggtggactacggcgacacctccctccagttcaccagcgatctggaagatgcggtggcggcggtggccagtgaggccgaaggggagctccccctgggctctctggtggccggaagcgacggcacccagtttttcctcctcgacccagtacagaccgcgccttaacccagagcgcctccgcccatcgggcggaggcgctctcttttggccacagccggtgccctcatccaagaggatgtcgtccacaccagccacgacagaaaacagagtgggcaccgcggcccggcgtattccgcccgcggtattgctttttcgtctgccacagcggaagccccggcagaagacgcagttccatcttgacttacatccgtattacttgtataatacagttataaactgtattagttctataatacagtatacaaaaaggggggtgtccggccatgctttccttctccggcttccgcctggaggacggaagccccatctaccagcagatcatccgctatctagagcagggcatcgcggccggaaccatccgggacggagacgggcttccctcccgacgggtgctctccgcccaactgggggtcaaccccaacaccgtgcagaaggcctgccgtatgctggaggaggcggggctcatcacctcccgctcgggggccaagagcgaatttaccctggacgaggcggctgtggccgccgtccgcacccgcctgatggagcgggaggccgccgccctggtccgctccctgcggcagatgggcctcacccggccggaggcggcggcgctcatcgaccggctgtgggacagcccggaactggaggaggagaagccatgaagcgtatcgcatccctgctcatgctggccgcgcggagcaccctctggaaagctgcggggattactctggcctcctgtctggcggaggcggggctcttcctggctgccctgtccggctggcaggacaccgtccgcaccgcttactacgaatactccaaccccatgggcctggagggcctgctgatgcaatatcccctgtcctggtgcttccgtatcgggctggtgctggtgtgcgccgtgctggcctttctggggtgggagggttcctcccgggtgagctataccctgcggcggctgtcggtggggcatagggccctcaccctgctgtgggccggctacggctttttctgcctgttgttcttctgggcggcccacctgggcaccctgctggccctctgcgccgccgccctcccccgtctggcaccggagttctccggcccccaggccctgttcctggcctgctaccgcgacccctatctccacagcctcctgcccttggacgactgtctcctctgggtgcgcaacctgtccatgtgcgccgccctggggacggcggcggccagcttctccttccagcggcgcatgggccgccgggccttcgccattctgcccctggcggcgctctccgccctctgctttcccctgcccatgggctcctttgaattcggcgggccggcggagttcctccgcccctatctctacgacggcattttctactccgcggacggtctgccctctgtcctggggcccgtcctgctttttgtcagcctgtgcgccctggccgcctccctctgccagattttgaggagggatccctatgaagaatgagtcctggtttcccctcggcatcccctggaagcaggagcggtttctgctttggacgggcctgctcctgtccgccggcgccggactggtgctcttcctgtgccagtacctcccggcccgccgggccctctacggctacgacggcaccgtgggcccggacggcgcgttggtgcgggtgctcctgcccggtaccctgatgccccccttcccccacctgctctatgggctgctgctctgttttctggcgctggccctctccctggccggggtggccgtctaccactttctctgccactatcagggcggccggagcatctaccggatgcggctgctcccccagtccggggagctgtggcggcgctgtctggccgcccccgccctggccctgctgctgggcgcggcgctgacggccgccgtcatcctgctgtgcgcactgtgctattaccacctgacacctgcgggccacctgcccccggagccctggggaggcctgccgctgggctggattggaggcaaccatgcttgaagtgagccatgtatccaaaaagtaccggggctgtcagcaggccctggaggatgtgagcctgtctgtggggcccggggagatcgtgggtatcttcggccccaacggcgcgggcaagaccaccctgctcaagtgcatcctgggcctgctcaagtgcggagccggtgcggtcaccctggacgggcagcccatcacccccaaaaacatcgcccgactctccttcgccacctgtgagcactccttcttccccggcctcaccgccgccgggcaccaggacttctgcgccgagcacttccccgccttccgggccgaccgcttccaggcgctgatggacttcttccgcctgccggaaaagcggactctgcgcggcttctccaccggacagaagaaccagtttgaagtgattctggctctgtgtcagggggcggactacattcttatggacgaacccttcgccggcaacgacgtgttcaaccgggaggatttctacaaggtgctgctgggcatcctggagcccaccgagaccatcctcctttccacccacctgctggaggaggtgcagcacttcatcagccgggcggtactcctccggtcgggacggatcgccggggacgtgaccaccgccgcgctggaggagcggagccagagcctgatggactatgtccggtcggcctgcggctatgagcccggccgggtgctccaggcgctggagcggatggacggcggaggggaggaatagccatgcggaaatccctgctgctctttgtcctcctgaccgctctgtccgccggactgctggcgggggcctgcgccgccgtgcagggccgccgggaggcggtgtcctaccgggcggaaatcctagccggggaccccgcggccgccgacggggtggagctcacctgggtgtccacctgcggctatcacctgttctggcacagcacctttcctgccgccgcgccggaggaggccgaaacccgcttttcctactccggccagaagcagagctggatcattgagctggacgaggatgtgctggggctctctcccggcctgaatttcctggatattgcgccggacagtccctccaccgggctgcgggcgctgtgggcggagctctccgcccagacctctcccctgcccggagacgagacctataccgaacacaatggtctcatcagtattaaacgtgagatccaactggccgattatctgaccgatttccccctctctgcggatcgtctcgcgtacacagcttgggcggctgaccgtgagtttggaacttcccagtacgatacctccatcaacgcggaggagctgacccgccgttttcgcgcctattttcccattccggtgcccgaaggtcttgccatggagatcagcatgaccccggacgcctccggccagctactgagcgcccactttctcacattggacagcagcctgctcacccttcaggcggactgcgtgagcaccggggagggcgtcctgtttgccctctgtgccggcggctccatggccaaggctctggacggcagcggaattcccggcggctgggggatctcccggctctcccccggcggcgacctggagaccgtctactccatccccaacggaggccgggccatggccttctggtcggatggggacggtaccctctttcttctcaccgaggagaagggcgcggttcttctcaccctgctggatgcagccacgctcacccctgttgccacccaggagctctttcccgcggcggagggcgcgccccacccacaggtgttcccacagtctgacggctctttctgcctcctgtccgcgggcgactttctggccgtgctcaaccgtcggagcggcgcatgggtggtggactttacggcggacacctccctccagtcctccctgggctgtcccttgagcaccccttcctccaggctcagcctgtgctatgacggaacccggctggccatcactggcccttgtccgagcacgaaatcggaatatttcctggcagtctacaccgccgacggcctggaatacctggggggctacacctccagcctgtacggcaaccaccccccggactgctacccctggggctcctggcaggacggaagctgccgctccatcgcgctggagccctccctccccggcacggaaactgcctcttgacaaattccctttccccggctaaaataagtgcaattacatcccaaacaggcaatgatgggaagaaggcgcgtcccgtcccgctcagagaaccggtggtcggtgcgaaccggcgcggggaagcgcgcggatactgagcccggagccgcccgtccgaaccccaggcagtagggcgggccgtcacggccacgttaccggccgcggccttgttggaggccatgagcgccccttggtgacaatgggcggaagcagggtggtaccgcgtaaattttacgcccctgaccaggaatttggtcaggggcgttttttcgtaccctggccccagtgaacaggaggaattgttatgaagcccgcacacgagaagtacatccccttcgtccccctcaagatggcccgccgcgcctggcccgacagggagctgaaagcgccccccgtctggtgctcggtggatctgcgggacggcaaccaggccctcattgaccccatgaacgtccgggagaagctggagctgtttcacaccctggtggacatcggcgtcaaggagatcgaggtggggttcccctccgcctccgagacggagtacgagttcatccgcaccctgatcgagggtggacacatccccgacgacgtgaccattcaggtgctggtacaggccagagagcacctcatccgccgcaccttcgaggccattgacggggccaagcatgtgatcttccacttctacaactccacctccaccctccagcagaaggtggtcttccacaccgacgtggagggcgtaaaaaagatcgccgtggacgccgcccggctcatccgggagctgagccagcccgccctcgacgcggggatggatctgcggtacgagtactccccggagtccttcatgggcaccgagatggacgccgccgtagagatctgccaggcggtgatcgaggccatcggtgccacgccggagcgcaaggtgatcctcaacctccccaccaccgtggagaactgtatgcccaactacttcgctgacgaaattgagtactttatctccaggctgcccggccgggaccgcgccattatctccctgcacccccacaacgaccggggcgagggcgtggctaccgctgaactgggcctgctggccggggccgagcgggtggaggccaccctgttcggcaacggcgagcgcaccggcaacgtggacatggtgaccctggccctcaacctctacacccagggcgtggaccccaagctggacttctccgacatcaataaaatctgcgacgtgtacgagcgggtcaccaagatgaagatcggcgagcggcagccctatgtgggcgagctggtgttcaccgccttctccggctcccaccaggacgccatcaataagggtacccgctacatggaggagagcggcaccgagtactgggaggtgccctatctgcccatcgatcccgccgacgtgggccgccagtacgagcccatcatccgcatcaactcccagtcgggcaagggcggctccgccttcgtcatgcagcactccttcggcttcgatctccccaaggccatgcaccccgagttcggccacatcgtccaggtggagaccgaccgggtgggcaaggagctgaagcccgacgccatttacgacctgttcaaggcccattacatcgacgcggtaaagccctatcagctggtgcagcactccttcgccgagtttaccgacgaggagggccactcccacgtcaccttcgccggcaccatccgccacaccgacaccgtgttccaggttcagggctccggcaacggccccattgacgccttcttcaacgccatccacggccagaagatggaccgcttcaccttcatcgactacaaggagcacgccgtcaagcagggctctgactcccaggctgtggcctacatccacctccaggacgagaacggcagggactggttcggcgtaggcatgagccataacatcaacctggcccccctcaagggcatcctctccgccatcaaccgggccgtcagccacgacggcaaatgaacgcccgtcccgtcttgcatccccggcctaaaccagctataataggaacagtttgacagaaaagaggacgcggacaatggaacagcagcgggaggccctgctcgggcaaatctgggcggcccaggacgaggcctatgacctgatgtatgaatacgactcccttccccaccgttacggggctcacattctctatcagtcggaggcccatatcatcgacctcatcggtgagcacccggagattaccgtcaccgagctggccgccattctgaaaaagactcccagcgcctgctcccagatcgtgcgcaagctgcgggccaagggctgggtggagcaggtacgcaacgcagagaacaaccggatttataatctatacctgaccgagagcggcaaacaggtctaccaggcgcacacagctttcaaccagtcctgtcaggaggccacctttcaattgttgagcaatttttctcccgaggagttggaacaccatctgatggtacagcggaaactgaacgaggcatatcaggatgatgtgaggcggagccgggattatttaggatagacacaaaagaagccgggggtatgaccgcccggcttctttgttgtggataatccacaaaacaaaagccaaatatttattcactataaagaagtatctaaaatatataaaaattttcttgacttatttcttatttgtcatattataaagatgcttaattattaagaaattagcaaatcaccaagagagggagatgtcaaatggaagctgaaaaaaagtacgcagaaacctatggagggaaggtcggcgggatacttccactgctgggaatgatcgcagcaatcgttgtcctctgctttaccggaatgagttccctacgaaacttctggggagcaggcttcatggccatggtcattggtctgctcgtgtttaaggataaaaaccgctatgcgaaagcagttatgaaaggctttgctaatccgtccttcaccatgctatttcccattttcattgcggccggtatcctgtcacagatcctaacggccgcccacctggtggatggcctggtctatcttgtgagtctggtcaatatcccacctgccattatcccctgcgtgaccttcgtactgtgtgcggtaatgtccactgtgacgggcagctcggcggccgccctcttggccacgatgcccatgctgttcccaatgggtgtgcagatgggctgtcccgccggcctagtcctgggtgccatctgttccggctccgagttcggtaataacctctcccccatttccgacgtgaccatcacctcctccatcggacaggaggtggatatcatcgccgcggtgcgcacccgtgtctggtacagtctggccgcagggatacccgccctcatcctgttctttgtatttggtcttgcaacaaccaagggggttgatctggcctccctaagtgtggacagttcctcctccctgggccttatctttatcatcattcccatcctggtggccgtactcatcctgcgcaagacaaacttcttggtagcccttgtggtaggcgatctgctgggcatcatcctgttgctgatcctgggctattcggacgtggcgagcatctttgccgctgacggcctattggcctccggtaccctcagcctgatggatgttttagtctttatggccctgatcttcgtagtactcgcactgactgaggaggtgggcgtgctggacagtttccagacctttatggtcagacacgccaagacccccagaatggcggaaacggtttccggggtgttcacctgtattttctgtgcgatcattggcagcggtatgtccacgatcgcctttatcagccccatcgtccgcaacatcatgaagcccttccatattgcccgaacccgcgccgccaactatatcgcgggctttgccagcggcatctcctggatggttccccacggcgtcaacaccttgaccgcactggcggttgcaatgggaaccggtgttgtgggcgatgactttaccatgttgaattttattccctacaactttttctgtattggcctgattgtagtatactgggccgcaattttgactggcatcggtcgtaaaaaagacgaaggaggattacaaaatgaagtatgatttcaccagcatattggaccgccgcggaaaggatgcagcggcctatgacaatgtgggtgcccatgtcattgcgcccgcaaggccaaaggaaggctttgatataatccccatgtgggtggcagatatgaacttccctgtggtccccaccatcacagaggcgattatcgcccgggctcagcacccttccttcgggtacttctttcccaccgacaaatactatgattccatcgtccagtggcacgagaagcgcaacggtgtcactggcctaaccaaggagcacatcggctatgaaaacggcgtgctgggtggtgtggtcagcgcactcaatgtactctgctccaggggtgacaacgtgctggttcactcccccacctacagcggctttacatcctgtctgaccaatgccgggtattccatcgtcctctctccactggttcaggacgagcaaggcatttggcgcatggacttcgaggacatggagaagaagatcgtggccaaccacattcacaccgcactattctgctccccccacaaccccacaggccgggtctgggagcgttgggagctggagaaggccatggagatcttccagcggcatggtgtctatgttatctcggacgagatctggtctgatatcatccgccccggtcagaagcacatccccacacagatggtcaacagctacgccaaggagcacacagtggccctctatgctccctccaagacgttcaatctggcgggcctgatcgggtcttaccacatcatctacagcaagtggctccgagatcgggtggataaggagagctccttgtgccactacaacgagataaacgtactttccatgcacgccctgatcggcgcctacaagccggagggctacgagtgggtggatgagttgaaccaggtactcgcgaataatgtggacttcgcctgcgaacacatttgggagcaatacaaaggtattcaggtcaccaagcctcagggcacttatatgcttttcctcgactgcaccaaatggtgtgaagcacatgggaagaccattgaagagctgcaaaaggctggctctgatgtaggggtagcttggcaggatggccgccgttttcacggcccctgccacatccgcatgaatcttgccctccccctctcccgtgttcaggaggcctttgcccgcctggacaagtatgtattcaacgcctgatagatgcaagaggcggcgccggttcccgtatggaaccggtgccgctcagcctgtcgaaaagaccttttcgacaggctgttgaacttttgaaacttcagaaaagtttcaaaagttgtttgatccaacgcgaaagggaaccctgacggttccctttcacactatccttccctccgaatccttcggcaggaggggttatcgacagcctcggcggcggtcccacatgggaccgccgccgaggctgtatttttagttaccgccgaactcgtggaagaagcggtcgtggatgacctgcactgcccggtcggcctcgttgatatccaccaggacggacaccttgatctcgctggtggagatcatgctgatattgatgcccgcattgtacagggcctcaaacattttggccgccacgccggggttgtggaccatgcccgctcccacgatggagaccttggcaattttgtcgttgacatccacatggtcgaactgaaggaaatccctgtgctcatccaggagctgcttgcagcgctccacatcctgaatgctcacggtgaagctgatatccttagtattattgcggccgatggactggagtatgaggtccacattgatccgctccttggccagcagggagaagatcttgaaagcgatgcccggctcgtcggccagccccaccacggccacacgggccacatttttatcgcaggctacgccgctgacgtgcagtttttccatggtttttgcaacctccttgactttggtgccgggcttgccggaaaagctggagaggacctccagattgacgccgtagcgcttggccatctccaccgaacggttgtggagcacctgggcgcccagggtggccagctccagcatctcgtcgtaggtgatctcctccagcttccgcgcccctttgacgtggcggggatctgcggtgtagacgccgtccacgtcggtataaatctggcagagatccgcgtggagcacagcggccagggccaccgccgaggtatcggagccgccccggcccagggtggtgatatcctcatacttgttgaggccctggaagccggtgacgatgacaatggtgttcttgtccagctcggccagcacccgctccgtatcgatgcgcttgatgcgggcgtcgccataggaggagttggtgcggaagcccgcctgccagcccgtcagggagaccaccgggtagcccatggcctcgatggccatggcgcacagggagcaggagatctgctcaccggtggacagcagcatatccatctcccgcttggaggcgttggggttgatctccgcggccttggcaatcagatcatccgtggtgtcgccctgggcggagaggaccgccacgacccggtggccccggcggtaggtctcggttatgatgcgggccacgttgcggatgcggtcggcatccgcgacggagctgccgccgaatttttgaacgatgagtcccattggtatatgtaccccctaaatcaggaatatccgtccgtcgcggaggaggcgcgctcctccgcgacattctatgcgctcagtccagcacccggaacatggagccgggcgtcatacccgtcagccgggcctccagggcagcccgggtcatgggcggggtgaccagcgcgaactcgtccgccggcgctccggggcggctcagccgggtactgtccgggaaggcggcctccgccgcctgtaccccggtcccccggaggtaccagcggctctccagcccgtcgggcggcaccgccgtatcgtccccgccctcggcccagaacatccgcttcttctcgtcccggtgcttggccgcgtcgatcacgtcggccaccacggcggaggcggtgggcagcttgcccgccccccggccgtagaacatcacatcgccgatggcgttgccccgtacggcgatggcgttgaatacatcctccacaccggagagggggttctcccggtccaccaggtgtggggccacataggcgcacaccttcccgtcggtccggcgaatagcccgccccagcagcttgagcttctttccacaggagtcggcataggccacgtcggccagggtgacgccggtgatgccctccgtgggcacctgccgggggtaaatatgccgcccgaaagccagggaggccagaatgcagatcttccggcaggcgtcgtggccctcaatgtcggcggtggggtcctgctcggcgtagccgttggcctgagcctccctcagagcgtcgtcaaagctcagccccgcccggatcatacgggtgaggatatagttggtcgtgccgttgaggataccggtgatctcctcgatctcgttggcggccaggcactggttcagggggcggatgatggggatgccgccgcccacactggcttcaaacagatagctgacacccttctcctgggccagccgcagcagctcgcagccgtgctccgccaccagctccttgttggaggtaatgacactcttgcccgcctggagggcccggcgggtgaaatccagcgccaccttggccccgccgatggtttccaccacgatggacacctcagggtcctgctcaatcacggaaaaatcgtgcaccaccttgcctgcaaaggggctgtctgggaaatcccgcacatccagaatatatttcaggcggatcagatcatccaccttgccctcgatgtgccgctcgttggtgtccagcacttcagccacaccggagcccaccacgccaaatcctaaaattgccacgttcaccattctgtcttcctcctgtccgggccgtcagcccgccaaaatctcacagcgcaggactccctctatctccagggcctggttcagtaactcctccagcgcgatgcgcagccccgaggtctccgcccccaccgtcaccgcagcacagccgttgcttggtatggactggttgatagtgagaatattcccacccgtctgggcaaagatattcaagacggcggacagcacccctggttcgtccttgagcaggaactgaaaggtgacgatccgcccatgcagcatgtcattgaagggccgcaccgcatccttgtatttataaaatgcgctgcggctgatgcccacccgccgggtggccaagtggaccgtgtccacctcgccggtttccaacagccgcttggcctccgccaccttcagaaaaatctctggcagtgcgctggactccacgatgaaataactgggtgacttacccattctatgtacctcccgcccatatgtccacgtgagaaagccatttgtttatcctttgtggtctattgtagcacaccctcccgcccgccgcaagggcaaagcccctgccaactctgccgatttctgccgatccgcccatgccgtttttgtgtattctcaccgattttcaggagaggaggctgtcttttgccggaaaacagacacctgcgctttctgctccgcctgctctatgccgccctggccctggccggattgtggctggccctgcgctttctcctcccctggctgctccccttcctgctggccttcggccttgccgccctgctggagcccgccgtacgccttctgatggagcgcctgcacctgccccggcggggcgccgccgcactgtgtaccgcggctctcaccgccgctgttctgggagggctggcgctggtggtatggcgggtaggctacgaactctccctgctgttgggccgcctgcccaccctgctggccgggctgcccacgctggccgacgggctggagcgctgggcctaccggttcctcatcgccctgcccgttcagttccaaaccctggcccgtgatgccctggagggccttctggagcagggcattgccctgcccaaccgcttttatgacgccctggccggggcggtgacagggctggcttcggcccttcccgccgccgctcttttcctctttacgacagttttggccacctatttcaccagcgcaggccgtcccgctctgctggacggcctgcgccgccgccttcccccgccgtggcggacacggctgggccgggtggccggcggtctgagggaggcgctgggcggctggctgaaagcccagggcctgctgatgctgatcaccttcggcgagctcgccgccggtttcctgctgctgcgggtggagctgtccctccttctggccggacttgtggctctggtggacgccctgccggtcttcggtacaggcaccgtactgctgccctgggcagtgctcgccctgttggggggcgacgtgcggatgagcgtgggcctgcttgtgctttactccgttatctctctcgtgcgaagcctgctggagccccgtctggtgggggcgcgggtggggctccctcccctggctgccctggtctgcatgtatgtgggctttcaggcgctcggagttcttggaatgcttctcgccccactggccgccgtgctggcccggcagctctgggattccggcctcctgcacagcctgttcggaccttaagcaaacagcccgcggcacatgccgcgggctgtttgtttctttatttcgtaccatccgccgggatatagggctcgtccgggggcgtctccaccggcgtgggtacgggagacggtgtggggcttgtgctggtctcgggtggattgggctggccgctctccccgggagacggggtctcagacggctgtcccgcgttgggccaggtggccgggttctccgggtcaaaattctcgtacctggggtcgttgaccggcggccaggtggagggatcactgatcacaaagctgttgggatcatactcctccggctcctggggctggggcgcggtggtgtggacgtcacaggtcccctgggcctccaggaagctgtagaggtaactgctgtccttggcggcggcaccgcccacgctctcccggctgtaatccaggatgccgatggtcttgaccgtgccctccgtgactcctgcgccctcgtcggcctgccggggacaaaactctcccgccagatgatacaggccctcaatcgccgtgccgtcgccgcccagcaccgggctgccggtgcaaacctccacctccttgtggagactacaggtttcggcgggcacgtcgtcgctgaacaaggtgaaggtgcgggcccggctgcccctgggatcgtttaggcaggcctcagtggcccgcaggccactgtccatgcagatgctgacgctcttctgttcactgccggcggccgggaaggacttgttctccagcccctcatggatgggggccatgaccttcttccacatggacactgccgggttattgctggagctgatgcgctccgggttgttatagcccacccagaccgcggcggtatagtagggagtatagcccacaaaccacttatcgttattggagttggtggtgccggtcttgccggccaccgtcatacctgagagctgggccccggtgccggttgccccgccgaatttccctgtaaccacatttttcagcatgtcgttaatataccaggtggtctcctcggagagaaccgcctcgggctgattctgagtattgtccagcagaacctcctccgtgccgtcgtccagcacacgggtgaccttggtgtaggtgcggggctccacatacaggccgttgcgtgggaacacggagtaggcggcggccatgtctaccacactcacgccgtcggtgaggccgcccagagcgagctggctggcccccaggtcgttcatcacctgtccgttgacggtgcggccgtcctccagatcgatatggaacttctcctccatgaactggaaggaattcttcacacccaggttctgtagggtgcgcacggccaccgggttggaggacacctccagcgccgccgctacggtcatcctcccccggtaggtctgggggttgttcagcggccaggccttgccgctgaggagctgcaccggatagtcgtcaaaagcggatgcaggactgatcaccccgctctccagagcgggcgcatagacgctcagcggcttgatggaggagcccggctgccgcagggagcggctggcgtagttccagccccggttgctgctcttttcgcctagggcgccggccagcccaacgatgttgccctgggggtcaatgattacgatggccgactggatcgcctgccccgacttgctggtgagctgaaggttgctgcggtcggagtagaccgactccacgatggactggatctccgggtccacacaggcgtaaatattcagtccgccggaggtgaccatgtcggaggccacctgctcggagtagccgtacttctctatgaggtcgttcatcacgtcggtgatgacctgctcgtcataccagttgtagatggtggcgggcctggcctcatcggtgctccgttccagatgggaggccagatcatcaatttcggccatggcctcgtcgtactcggactggttgatgctccccagctccagcatcttgcccagaaccagcgttgcgcggtactgattgttctccagatagcggtagggattgtaggccgaggggttgttggtgatggagatcaggctggcgcactcggccagatccagctccgacagctccttgccgaagtagttctgggccgccgtggccacgccgtagcagccctctcccaggtaaatatagttgaggtaccactccagaatctgctccttggagtaggtcttgtcaaagtccaaggcggtgaagatctccagaatcttccgttttaccgtcacatcgtcgtactgggtggcattcttgatgagctgctgggtgatggtggagccgccctgaatatcgccgccggtgaacatgagcagcacccccttgagggtacgcttccagttgacgccgtggtgcttccagaacgtctcgtcctcgatggccacggtggcgttgatcagattatctgggatctcctcaaagtcgaccagttggcggttttctgttccatggagggacaggtgctccacatattcccccgtagtggaatccttataataaatcgtactggtctggttcatgacgaaattggcctccagatgggcctgcgggatgatgaccgtcttgatgtagaccgcggcaaagcagagcaggatagcccccgtgatcacgcagatcaggaggaaggtgcccagcaccttccctaccgtgcccgcaaccaccgcagccgtggacggccgcctccgcttccggccccggttcggattggggccctgattggatgttgacgccaaaatgacacctccgtttttcggtggaacacgtatgcttgcaggatcgcctcatcacatgcggcgattgctgatattatagcatattcctccagcttgtccaccctaattctttccaataaaggatgaatataggcttcgtcaaaaatttggcagatcccactcttgcatttttgggcgcaacaggctacaataagagacgaagaaaaggaaggtatggtgcccaatatgagtgaagaatttggccctgatttcatcaccgtcactgatgaggacggcaatgaatttgagctggagcatctggacacactagagtacaacggccagacctacatggcctttttcccggccgtggaggggaaagaggacggctctgtagaggatgtggatctggatgaggaatacggcctggtgatcctcaaggtgatcgaggcagacggcgaggaacagctctccaccctggacagtgaggaggagctggagctggtgtatcagcagtttatggagtccctcttcgcggaggaggacggctcggacgcataattttttcctgctcggtgcgtgacgggttttatttaaacccacatctctgaaacgggatgcccacctcatggcgtggactgcaggcctcccggcgcccctccgggggacggctggaagttggaagcaacgaagcgacatggaggcaacccacctgccactttgtgcaggttttaaatggatccgcacggccagagcggggcccccacgaaacgctgtttcgtggggtttttcttatttccggcatttgaacaaagtgtaaaacctgttttcgctcttgaaagagtgcggcatttcctgtataatgtcagaatgtctatagccaggccccctgctcccgcggggggacacttatgagaggactgaagctacaaatgagcgcatccagagaaaagaaatcgcgccagagcgacccgacacagggcctgactcaaaaggagaggaaggagctccaggagcagcaggccgccaagcgcaaggccgttgtctatacggtcatcggcgtcattgttgccgtgctggtggccgccctgctgatctggcactccggcatcttccagcgcggcaagaccgctctgacggtgggcggccgcgattactccgtcaccgatgtcaactattatttcacctattatatgaatcaggcatacagcaccagcggcggcgcttttgatcccagcaaggatctccgaacccagtatacggacgaggaacagaccaagagctactttgaccagttcctggacagtaccattgagcagttgaagaagatttctgccctggagaccgccgcctctgaggccggctacaccctgtccgacgatgacaaggcctatgtggatgaggccatctcctccaccaaaaaggctgccgagtcctacggctatgcctatgacggctatctgaaggccatgtacggcaagtatatgaccccctccgccttcaagacctgtgtggagcgggaagctctggtgaacggttaccagagcgcctacgccgacagcctgggcattaccgacgaggacattcaggcctactatgaggagaatgcctccacgctggacacctacgactaccgctatatctatctcagcggcaaggccgcgtccaccaccgacgaggacggcaacacggtggagcccactgaagaggagacgaaggccgccatggaggctgccaaggccaaggccgacgcgtttgtggctgcggtgaattcctccgatgacaaggaaactgcctttgccgagctggcccccgactatgtgtctgaggacgacaaggaggactatgaggcggatcccgacgcctccctgcacaccggcacggtgggcagcagcctctcctatcagagctttggcaagtggctgatggatgacagccgcgccaacggcgatgtgggcgtggtggagtccagctccggctactacgccgtcatgctgttgaaccgctaccgggatgagactgccactgctgacatccgccacatcctcatcaaggccgaggtggccgatgccgatgaccccgccaccgaggacgtggacgagagcaaggtgcccactcaggaggccctggacgccgccaaggccgaggccgaggacatcctggcccagtgggaggcgggcgacaagactgccgagtccttcggcgcgctggccgaggaatactccgacgatcccggctccaacaccaacggcggcctgtatgagcaggtcgcgcccggcgtgatgttcgagggcttcaacgactggatctttgccgacggccgcgccatcggcgacaccggtctggtggagaatccccaggacggccagcagggctggcacatcatctacctggagggctgggacgagcccgtctggaagctcaccggcaagaacgcgctgaccaacgagaagctgaacacctggctggagggcctgacggaaaacatggaggccacccagggcgccggcgtcaagtacctcggcgagtaagagacatcatgggacaggcgggcggagcgctgctccgtccgcctgtttttggaaagggatgaactgcatggacgagaggtttctccgcacagagatgcttttgggcccccaggccatggagcgcctggctgccgcccacgtagccgtgttcggtctgggcggcgtgggaagctggtgcgccgaggccctggcccgctccggcgtgggcgccctcacgctggtggaccacgacacggtgggtctgaccaacctgaaccgccaggtggaggccacccgctccaccctgggccagcccaaggcccaggccatggccgaccgtatccgcgacatcaatccggactgccgcctcaccatccgggcggagaagtatgaggcggggcggcgggaggacttcttcgaccagccgctggactacattgtggactgcatcgacctggtgtcctgcaaactggatttgatcgagaccgccctcacccggggcgtccccatcgtctcctccctgggcacaggcaacaagctggaccccggcctgttccgtatcaccgacctgtcgaaaaccgagggctgccccctggcccgggtggtacgcaaggagctgcgcgcccgcggcatcctccaccaccgggtcctctggtcgccggaggagccgaaggccgccctccagcgggaggcgccgccccccggccgccgctccgtccccggcagcgtggcctgggtgcctccggtggccgggctcatgctggccggagaagtggtcctgtcccttgccgggctgcacgtataaagacatccctccattggtaaactaaagccaatggagggatgttttttgacgcagaaaaaaggctcccggctccgcagcgcggcggctggcggagcggccgggctggccaacggctttttcgggggcggtggggggatgctgctggtgcccctcctcacccgctggtgtggactggagcagcgccgcgccttcgccacgtccatcgccattatcctccccctgtgcgcactctcgtccgtcatctactgggttcggggcggactggactttgggctggccctcccctatctggccggcggcctgctgggcggcttcgtgggcggaagggtattcaagaagctgaatatggtctggctccgccgcgcctttgccctgcttatcctctacggcggcgtcaaggcgctgttcttctgatggcttggcccatctccctcctggccggcgccgtcaccggcgtgctctccggcttcggaatcggcggcggcaccctgctgctcatctatatgactgcctttgccggggtaccccagaatctggcccagggcgtcaacctgctctactttcttcccactgccgccaccgccctgcccgcccacatcaaaaatggctatatcgaccgtcagaccgtctggcccgccgtcctggccgggctggcgggcaccgctctggccgcctgggccgccaccggcctggatgtggagctgctccaccgctgcttcggcggtttcctgatcgtggtggggctgcgggagctgttcagccgctcgtagggatatccatacgaaccatgtaggggcggccacaaggttcgccccttcatccgccccgccgcctgaaggtcagatatccctccagaatcagcgtcgccgccaccgcgtccctcccatccggccatgccggatgggaaccctgatgccttttggcatgctcggggcaagtgaattgcccctgcgccaagattttgctccgcaaaatacttgtatggcgcaagcgccgccccgctgcgcgggaaaccgtggacgcctcttttactcacagccgctccgccgcctgaaggtcagatatccctccagaatcagcgtcgccgccaccgcgtccacggttttcttatgctgcttcatccgcttgcccgaggcatggaggatgccgtgggcctccaccgtggtgcggcgctcatcccagagcaccggcttgaggccgcagacctcctccagccgggcggcaaaggcccggtagagctcggcccgggggccttcagtgccgtccatattccgggggaagcccattaccagctcgtccacactgtgctctttcgcaaggcgggccagctcctccgccaccaccccctccttccggctctggatcaccgtggtgtagccggccagcaggccggtgggatcggagattgccactccggtgcgggcatcgccgtaatcgatggccataatacgcaaatctaccactccttttccgtaccactatagcgtactttttgggaaaaaacaaggaaaaagcgcttgacttcccatatgagctgtgatagacttgatacacctatgaaaaagggctctttttttgtgcgcatttttacggtgtgatgacgtacaaaacccttccctcactgtgaggacatagggaggcaagcatgccgaatccgcaccgtgacgtaacatagtgggcgcagtctatgcgcctttacgttgctggattcggcccaagggctgtgtccagcttttttgctgcgcgcggtcaaacaatgaaggaggtgccgaacatggcgaaggccggcaaccgggtgaagatcactctgcgctgctccgagtgcaagcagcggaactacaacaccaacaagaacaagaagaacactcccgaccgtctggaattgaacaagtactgccccttctgcaggaagcacacggttcataacgaaaccaagtaatgagtgctgctatggctcagaagaaagaagggttaaacggaatgtctgaaaacgagaagctcgagcaggccgccgaccaggctgccgacaagcccgcgaaaaccgataagaaaaaggacgtcaaggctgacaagaagaagcccggcgtgttcgctcgcatcggcaagtggttcaaggatatgaggagcgagctgaagaaggtccagtggcccacccgcaagcagaccgtcaacaacaccgtcatcgtgatcatctgctgcattatcgttggcatctgtatctggctgttcgatgccctcgccggcgccgtgattaccgccctgctggatctctttggtaagggttaaggtgcgacatggctgacaatgcgaagtggtatgtggttcatacctattccggctatgagaacaccgtggccgccagtatcgagaaggccgtggagaaccgcggcctgcgcgacctgattcaggaggtcagcatccccctggagacggtcaccgagatcacggataacggcccaaaaaccgtggagcgcaaggtcttccccggctacgtgctggtgaagatggtgatgaccgacgacacgtggcatctggtgcgcaacatccgcggcgcaaccggctttgtcggctccggcaacaaggccatccccctgacggacgaggagatcgccgccctgggcgtggaaaagcgcgaggtggtggtcggctatcaggtgggcgacaacgtcaaaatcaccgacggtgctctggagtccttcctgggcacggtcgaggagatcgacctggaccgcagcaaggtccgggtggtggtctccatgttcggccgcgaaacccccgtcgagcttgagctggaccaggtagaacctgtccaggactgagctccgggccgggcggcccattccccgcacgtgggagggactgcaccgcagttccgcttccaaccacatttatcgtaggaggtgctgtttcaaatggcacagaaaattactggttatgtgaaacttcagattcccgcgggcaaggcgactcccgcgccccccgtcggtcccgccctcggtcagcacggcatcaacatcgccgcgttcaccaaggagttcaacgagcgcaccaaaaacgacgtgggcctgatcatccccgtggtgatcaccgtctacgccgaccgctcctttaccttcatcaccaagactccccccgccgccgttctcatcaagaaggcgtgcaacatcgagtccggctccggtgtgcccaacaagaccaaggtggccaccatcagcaaggaggatgtccgcaagatcgccgagaccaagatgcctgacctgaacgcggccagcatcgaggcggccatgagcatgatcgccggcaccgcccgctccatgggcatcgtcgtgggcgactaaggcgaaggagggaaagagcaatgtttagaggcaagaaataccaggagagcgccaagctgatcgacaaggccgctctgtatgataccgctgaggccatggagctggtcgtgaagaccgcccccgccaagtttgacgagactgtcgagctccacgtgaagctgggcgttgactcccgtcacgccgaccagcaggtgcgcggcgccatcgtcctcccccacggcaccggcaagacccagcgcgtgctggtcttcgccaagggcgacaaggccgaggccgccaaggccgccggcgccgacttcgtgggcgagatggacctggtggagaaaattcagaaggagaactggttcgactatgacgtggtcgtggcttctcccgacatgatgggcgttgtgggccgtctgggtaaggtcctgggtcccaagggcctgatgccctcccccaaggctggcaccgtcacccccgacgtggccaaggccgtcaccgagatcaaggctggtaaggtggagtaccgtctggacaagaccaacatcatccactgccccatcggcaaggtctccttcggcgccgagaagctcaccgagaacttcaacgctctgatgggtgccattgtcaaggctaagccttccgccgccaagggtcagtacatccgctcctgcgtgtgtgcttccaccatgggccccggcgtgaagatcaattccgcgaagctgatgtaacaagaagcgcgggggcccgtggagcagctgcacagcgcaccccgcagacgaaaaagcagttgcgccgcaggcgcaaggtgtttttcgcggaggggtaagcagtgtggtgtcgcgcagccgccgcagcgtgacaagaagcgcgtagggtaggcgcataggggagctaagaggccatggaggcgaaaaaacaggctgggcgaagcccagcggcatgtttcgcggaatggccgcttagctccccgaccatgcgcccaacccgcagcgtgacagcgtcgccgcaagctccagatccttcgcttcgccgccagcggcaaagctcactccttccgctgcggctccttttccccacgcgaaccgcttcgctgggttcgcgtgggggcctcgagggtgagagagcaacggaagcgggacgagttcgccgtagcggcggatacgggccgacaggccccgcaaaaaaatgtcattttcggacaggttgtgcttgacacagcctgtccgggatgatatactattaaccgtgttcaaagacagcaggtgggcgcaagccggaaatcctgccgagaatgcagccacaacgggataaaattctttgtgctgttttcgcctgctttgaatgcgaaaacagcttttttgttgcgtctgcatcggaaaagttggactcaatctcaacggaggtgaattccaaatgcctaacgcaaaggttctcagcgagaagcaggccatcgtggccgagctgaccgagaagctcaagaccgccagcagcggcgtgcttgtggactacaagggaatcactgtggctcaggacaccgctctgcgcgccgagtgccgcaagaacgagctggactacgccgtcgtgaagaacaccctggtgcgtttcgccatcaacaatgtgggtctggaggagatggattccgtcctgaacggcaccacttccctggccctgtcccacggcgatcccatcgctcccatgcgcgtcatcaacaagttcgccaagcagttcaacggtgagaagttcaccatcaaggccggtttcatggacggcaaggtcctgtccctggacgagatcaaggctctggccgagctgccctccaaggaggttctgcaggctcaggttctgggcaccatgctggcccccatcaccagcctggccatcgtcatcaaggccatctgcgagcagaagggcgactctgtcgaggccgccgaggctgtcgagtaactcgacacacatttttacaaacatttatttaggaggttacctatcatggcttctgagaaaatcaatgccctcatcgaagaggttaagggtctgactgttctggagctctccgagctcgtccacgctctggaggaggagttcggcgtctccgccgccgctatggctgctcccgccgccggcggtgctgccgctcccgctgctgaagagaagaccgagttcgacgtggtgctggccgaggtcggcgccgagaagatcaaggtcattaaggctgtccgtgagatcaccggtctgggcctggccgaggccaaggctgccgttgaggctgcccccaaggccatcaaggagggcgtctccaaggacgaggccgaggagctgaagaagaagctggaagaggtcggcgccaaggtcgagctgaagtaagctttttcactcgcttaccaaaaagagctgtatcccgtctgggatacagctcttttttcgtgttacgcctccagtcccctccaagcggcaaagcgttgccagagcaggcaggccagccagccgcagaacaggcccaccagcaccccggccagcacatcactggggaagtggactcctacatacagccgtgagaagcccatcagggcggccagcaccaccgccgtcacccccatccaccggcggggcagagtgcggcaccaggccgacgctgcggcaaaggaggcgctagtgtgtcctgaagggaaggagttggggtcgtgctccgcgatcagaggcgtcagcccctccaccgtcagccagggccgggggcgctccaccaggtgcttgagaatcccgttggtgaacatcaggctcagcagcagggccatcaggccagctgctcccgccttccgggtctttttgaagcagagcagaaggacggacagggcaatccacatcagtccgctgtcacccagatgggtgtagagcgtaaacaggggtgtcaggacggcgttgcgcaccgcctcctggagccagagcaggatgcctccgtccagattcagaaaccattcgggcatattgtttcctccatataggagaggggcggcgacatggctgccgccgcccctctgtgttcttttgtcttactgagcatcggccgcagccgcgccgtccccccactcgcagtccagaatgacgccattcatcagctcaaacttgtcggtctttaccgtatgggtcttacccacacgcacctcctgggtgccgatctctgtggtaatggggttgaccacgttgcactcgatggtgaagagcaggtctatggtgccctcatccaccggaatttccagggtgccgtcagtggtatccaccgtcacggtctgctcatgggccctcggctccacagaaaccacctggccatccagcatctcgccggaggccatcaattggccggggatgtatttctggatattgtcgtagacctcctgctccacacccttgaccagcacggtataggttacctgggtcttgccgggattgatgccgccgcccccgtccttgcccaggaacttcacgcccagcaccactacggccacaaggaccaccagaatcaccagcagatccacaatgttgagcttgccaaacaatcttcccttttcgtctatcatcttttgtaacctccgaggttgtaaattgacataatacttggtacaatgatacttgcatattgtaccatacttccctaccctgaaacaagtcttttctttgtccggaggttttcatatatgaaagtcatcactctgatttccggcggcgacagcggcggagccaagactcacgtccactccctgctgcaaaacctctcccgcaccatcgaggtgaccatggtctgctttctggagggcccctttgcccaggaggcccgggaactgggcatccctacagtggtgctctccggccgcaatctgctgcgcacataccgcactctcaaacggatgatccgggaggggggctatcagcttatccactgccacggcgcacgcggcaacatgatgggcgccctgctgcgccgctccaccggtctgccggtggtgaccaccgtccactccgactatcggctggactatctgggccgccccctctcccgcctcacctacggcaccatcaacaccatcgccctgcgccggctggactaccgtatcggcgtgtccgacgccatgaccgacctgctcatcaagcggggctttgatcccgacaggctgttcaccatctacaacggcatcgacttcaccccccgcacccctgccctgagccgtgaggaatacttccgctccgtggggctggaggccgatggggacagtgtagtggtcggtatcgccgcccgtctcaacccggtcaaggacatcgccaccctggtccggggctttgccaaggcccatcgggagtgccccagcctgcggctgctcatcgccggcgacggtgagcagatgtccatgctcaaggggctcgccgctgagctgggggtagaacgtcaggtgtgcttcgccggatgggtcagcgacaccgacagcttctaccacgccatcgacatcaacaccctcacctccctgtcagagaccttcccctactctctcaccgaaggggcccgggctgccctgcccaccatcgccagccgggtgggcggcgtcccctacctcattgagcacggcgtccatggcctgctgttcgaggcgggcgacgcggataccctggcccgccacctgattactctggccaaggaccccaccctccgccaacacctgggggagcggctctatcagcggggcagggaggatttttccctggagagcaccctggagcgccagctcaacatctatgagaccattctccgccgccagagccgcaagaagggccgccgggacggcgccctggtatgcggcgcctacggccggggcaacgccggtgacgacgccatcctggaggccattgtcaccgagctgcgccagatcgacccggatctccccatctgggtgctctcccgcaacccggacgacacccgcctcacctaccgggtcaactccatctacacctttgccttcccccgcttcctgtggcggatgcgcaaaacccacctctacatcaacggcggcggctccctgatgcaggatgtgaccagccaccgctccctgtggttctacctgtttaccatctcctgggccaagcggctgggcaaccaggtgatgatgtatggctgcggcatcggccccattcactcccccgccaaccgccgcagggcctcccgcgtgctccagaagagcgtggacgccatcaccctacgggacacacactccgccgaggaactggaggacatgggggtgacgaagccgcaggtcatcctctccgccgatcccacggtgatcctccccgccgcaccggcccaagtggtggacggcattctggagagtcaggggattgacccccacggccgctacatcggcttcgccctgcggccctggccggggtttgaggccaaggccgccgtcttcggcgctgcggcggactacgcctatgagacgtacggcctcacccccgtctttctgcccatcgagcggcgtctggacgtgggggcggcccagttggccgcccagcacatgaaggccccccactacattctttcccagaccggccgctccgaccacaccatcggtctgttcgcccggatgcaggcggtggtctccatgcggctccacgccctggtcttctccgccggtcagggtgtgcccctggtgggcgtggtctacgaccagaagatcagctccttcctgtcctacatcggacaggatctctacaccgggctggacgaggtgacggaggaggccctgcggtcccacatcgacgcggcctgcgcccgcatcggggatgaggccttcctctccggcggcgtggagcggctgcgccaggtggaacggcgcaacagcgagaccgcccggatgctgctggagaggtgagggacgtgagacagattctctgcctgtctgctgacccctggcgcactatccccacccgcacccagcagcttatgacccgcatgcgggacgcccaggtgctcctgttcgagccgccgggaaaatactcccgacagccgggccgcagggtgcgccccggtctcacggtctgcgccctccccccggtgctggaggcggaggagcggcaccgcctcctgttccgccttcactaccgcaaactgggtaagtttatccgccgccagatggagcaccaccgttttaaggagccgctgctgtggtgcaccgcgccggagcacatccacctgctggacgaggtgccccaccggggtgtggtctacgactgcaaccgggactggcccgaccagtccccccggtgggagagcgatctggccctggccgccgatgtggtctttgccgcctcccaggggctcattgaccacctctccccctgcaacgacaacatcgccctgctgcccaacggggtgaaccaccccatgtttacccggccccccgccgagcttccgccggagctgcgggggctctccagccccattctgggctataccggcaccctgtggcgggatctggacctcgcccccgttctgtacgccgcccaggccatgccggcctgcaccttcgtctttctgggccgccgggagaagaaccccatggccgagctgctggagcggctgcccaacgtccgcctcctggggcggcgggcgccggtggaggtgcccgactacctggcccgctttgacgtatgcctcaacctgctgcgccgttccgagcagggcaatgacgtggtgccctgccgcatctacgaatacctctcctccggcaaacccgtggtgtccattctctttcccgagcaggtggagcacttccccgacgtggtgtacggcgcccactctccggaggaattcgccgccctctgccgccgcgccctggcggagaccggcgactgggccaaaaaccgccggagggagcatggggccgccgccgcctggtcggcccgcgccgacgaggtaacccgtattctcggtaccaccgggctctattgaggtatgagcgatggggccccaatttctctcacatacaacaccccctgtccccgtagaatggggacagggggtgttgtcttgtctctgtctgatcttttcacacaggtagcccacaatccggtactggggctgacctgtctgctggtgctggccgtggtgctggtcaacggctggaccgacgcgccaaacgctatcgccactgtggtatcaacgggagttctctcctttcggcgggcggtcgcgctggcggcggcatgcaacctgctgggcgtcctcgtcatgacggcaatcaacgcaacagtagcggagaccgtctactccatcgctgacttcggcccggaccgggccgcggctctctccgctctctgcgcggcgctgtgcgccattgtcctttgggccgtcctggcctggcgcttcggggtgcccaccagtgagagccatgccctggtggccgggctcaccggggccgccctggccctgcccggcgggctggacaacatccgggctggagcctggggacgggtactcctgggactggtcctctccgtggcgctgggctggtgggtgggcggcctgtgccgccgtctgctggagcgcctgcacccctccctccccctctgccgccggggccaactggccggggcgggcgctatggccttcctccacggggcccaggacgggcagaaatttctgggcgtctttctcctgggcgccgcgctggcccaggggggcggtgtgggccaaaccttctccgtgcccggctggcttatgctgctctgtgccgccgtcatggccctgggtaccgcgatgggcgggcggcggatcatcgaaaccgtgggtcgggacatggtgattctggccccccgggagggtctggccgccgatctggggggcggactttgcctgctcctgtgtacgctggccggccttccagtgagcaccactcacgccaagaccgccgccattctcggggccggctccgccggcggggggacggtcaaccaccgtgtggctgcccgcatcgccctcacctggctgttcacctttcccggctgcggcctgctggggtttttgttggccagcctcttccgttcccccctctcctgtggtatactgatgcccggtacgattttctgacattcgacacaggaggctccaaccatgtacccctacgacacagtcatctttgatttagacggcacgcttctgaacacccttcaggatctggccgacagcaccaattacgctctggcgcttcaggggatgcccgcccgaacgctggaggaggttcgccgcttcgtaggcaacggcgtggggcggctcatccaccgggccgtgcccgaggggacgcccgaggaggtggaagcccgcgtcctggccgacttccgcgcccactataccctgaatatggagcataaaaccgccccctaccccggcgttctgcccctgctggaccgtctggggcaggccggtatccgcaccgccgtggtgtccaacaaattcgacagtgcggtaaagggcctgtgccatgcctattttggggcgcgcatcccggtggccatcggcgaatcccagggggtagcccgcaagcccgcgccggacacggtattccgcgcgctggaggagctgggcgccggaaccggccgggccgtctacgtgggcgactccgatgtggacatccagaccgccgccaacgccgggctgccctgcctttcggtgagctggggcttccgggacgcggagtttctcactgcccatggcgcccagcgcatcgtggacaccccccaggcattggaggccctgcttctcggcgcataaggccaaaaagcccccgccatagctttgctatggcgggggctttttttaatacatcaggttcttctcggtctcagggtcaaagaggtggatgaggtcggggcggaaggcaaagttgatctccgtgccgtaggggatgccggcccggtgctcggcgggcaggtcggtggtggggatgcgcagcaccacgtcgcgccccacggcgttgacgtgcaggtacacctcgctgcccatcatctcggacacgtccaccttgctggacacggtatcgctgccaggggcagcggcaaaggcgatgtgctcgggacggatgcccacagtcaccttgcgctcgcccacgcccttcccgaccagcagctcctgggccttgccgcccagcaccacggtggcctcgcccaccttgagctggtacttgccgtccttcttctccagctcaccgtcgaagaagttcatctggggggagccgatgaagccggccacgaacaggttggcgggctggtcgaacacctcctggggggtgccgatctgctggatgaagccgtccttcatgatgacgatgcggtcgcccagggtcatggcctcggtctggtcgtgggtgacgtagatgaaggtggtgttgatgcgctggcgcagcttgatgatctccgcacgcatctggttgcgcagcttggcgtccaggttggacagcggctcgtccatcaggaacacctggggatcacggacgatggcgcggccgatggccacgcgctggcgctggccgcccgacagcgccttgggcttgcggtccaggtactgggtgatgtccagaatctcggccgcctcccgcaccttcttgtcgatctcctccttgggcaccttgcgcagcttcagggcgaaggccatgttctcatatacggtcatgtgggggtacagggcgtagctctggaagaccatggcgatgtcccggtccttcggctccacgtcgttcatccgcttgccgccgatgaccagatcgccctcggagatatcctccaggccggcgatcatccgcagcgtggtggacttgccgcagccggaggggccgaccaggacgatgaactccttgtccgcaatctccaggttgaagtcgtgaaccgcggtcaccttgttgtcatagatcttcttcacattcttcagggatacaattgccatgttcagggccgtaagggcaatgcctccgcaaataccctcttgcccgcagagagcgtcactctgcggacgttacggcaggtctccacactgccgcaccgccggcccggcgggtgttcctcctttttgaccgctcctccgccctatgaaaatggagtagggtcggaaggcttgaattttggggcgcacgtttactggctgaccagctcgccgcggaagaagacgtccttgacgtcgagattttgatccagaaccaccacattggcccgcttgccgggctccagactgcccacccggctgaagatgccgatggccatagccgggttgacggcggcggcccgcacggcatccgccagggggatgccgaaggatacagcggtcttcatgcacttcatcaggtcggtgacggagcctgccaaggtgccgtcgctcagggtagcccggttgcccttgacctgaacggcctgaccgcccagggtatagtcgccgtcaggcatgccggcggcccgcatggtatcggaaatcaggatgacccgcttggagccgaacatcttgaacacagcccgcaccaccgaggggtggatgtgcacgccgtcacagatgagctccacattgcacaggggggtgtccagggcggctcccaccacaccgggggcccggtggctgaaggccggcatggcgttgaacagatgggtcacctgccgggcccccagacggaaagcctccatagaggtgtcatagtccgccgtggtatgggcgatggacacggtgacttctccctccaccgcctcaataaactccatggcacccggctcctccggggcaatggaaacgagcttgaccagtccctgggaggcggccatcaggcggcggaacatagccacgtcgggggcgtggagccacgcgccgttctgtgcgccctttttggccatggagaggaagggtccctccagattgatgccgcagagggcggcgccgggcttatcggcggcccgatgggcggcggccacctgacagatcttggtgagctgctcctccgtcagggtcataccggcagggcagatctgggtgaccccccgggagagctcatattgtgccataatctccaggccctctggttcggcgtcggagaagtcccggcccatgcagccgtggaagtggacgtcggtgagaccggggatcacatagcagccggaggcgtcataggtcttcccgtccgcgctggagccagagagcaggcggccgtcaaagcagatgtcccgctggacaaagccctcctgcaggtcgaacacttgagcgccggttatccgcatacggtcacacctgcttccaccagcttgtgaagggcggccttgtcgcccaccagagttacgtcaggatggagctggagcacagaggcgggaacctccttggtcacggggcccgtaaacgccttgcagacaatgtccgccttttcctcgccgctgaccaccatcaggatgcggcgggcgttcatgatgttcttgatacccatgctcagggcgtggcggggcacctcatcacggctctcaaagaaacgcttgttggcctcaatggtactctcggtcagatccaccacgtgggtctccaggccgaagtcgtcgccgggctcgttgaaggcgatgtggccgttatggcccatgcccagcaactggaggtcaatgccgcccagctccgcaatgagtttattataggccgcacactcggcattggggtccttggccaggccgttgagcacgtgggtgttctccggatggatgtcaatatggtcgaagagattgtcctgcatgaaatagcggtagctctgctcatggtggggggacagcccgaggtactcgtccaggttgacggagcgggtctccgcgaaggacaagtcgcccttcttataccactccacaagttgctgatagagccctacgggggtaccgccggtggccagacccagcacgcagttgggcttgtagatcacctgcgcagagataatgttggccgcccggcggctcatggccttgtagttttcggcttgataaatgcgcattgcaaccatctcctatctttacagagtgggacgggcgcagcctacgcccgcccctgggcgttccaatggatcagcagaacttagccacggcggcggcgatcatagcgtgggcctcgtccactacagccgcatcgctgtcgatcagggcgggcatgggcttgcggaccgagccgcagggcacgccgtccttggccaaaattgctttctgtacggcgtacaggttgccgtgggcggagcacatcttgtagatgatgtggtcaatctcattctggatctggcgggccgcctccatctcacccttctggaagtgctcatacaccttcaggaagagctcgggcataacggcataggtacctccgatgccggcgcaagcgcccatggccagaccggagatgaactgctcatcgggcccgttaaaaacgagcagatcctcgtcatgccacatctggatatcctgggttggcatggaggagttcttcacgccgatcacacgggggtttttcttcatctcccgcagcagagaggtggtcagggccacccccgccagttgggggatgttgtagatgacaaagtcggtgttgggggcggcggcggagatatcattccagtactgggcgatgccgtactcgggcaggtggaagtagatgggaggaatggaggcgatggcgtccacccccaggctctccgcgtgggcggccagcacctggctgtcggcggtgttgttacatgccacgtgggcgatgacaaccaccttgcccttggcctcggccatcacgttctccagcaccaccttgcgctcctccacgccctgatagatacactcgccggaggaaccgcccacatacaggccgtttacgcccttgccaatcaggtggcgggtcaggccccgcacccgctccggtgagatattcccttcctcgtcatagcaggcgtaaaacgcggggataacaccgtggtatttcttcaaatcgctcatgatagtatccttctctcttctcaatcagaatctcattttatagaggctccgttcttttggcggcacatttgtagcgcaggctccgctggctgtgccagcggaggggcagcacgagcggcgcgtcagcccttgactgctcccatggctattccctgggtaaagtacttctggaacgcgatgaacaccacgatgatggggatggccgccagggcagcaccggccatgatgaggccgaagtcggaggacatctcgccctgtaggttggcaatcgccaggggcagggtccacttctccttactggtcagcataaccaactgaaggaaatagtcattccaggtattgacaaaggtaaaaatggccagagcgccgatgccgggcttgatcatggggaacaccacgctgaagaaggtcttcagctccccggcgccgtccacccgggcagcctccagaatttcattagggatcgtctcagagaactgcttcatcaggaagacaccaaagggccagcccacggtgggcaggatgaccgcccacaaggtgtcactcaggtgcagcagcttcatctcctgagccagagggataacaatgacctgcttgggcagagccatggcgcagatgataatggtgaacaggatggcccggccgtagaaccgcttcttacccaaggcatagccggccagagcagcagtaatacaggtcaggagcatggccatggcagagatgaacacaatattaaacagccacagaaaagcagggttctcaaacaggcgggcatagttgtccacagtggggttctggggaaaccagatgggtacgcgggaattgatctcgatgacatccttgaatgaaccagtgacaatccagtacagggggaacaggaagaagatcaccagcaggatcagaattaccacggcgacggccttataagccgtagaagtgccgctcagatcagtttttttcactttgactgtggtcgtatttgcactcattttctcactccttccttagtccgtcttcgccactttgaactggatggcggagaaaatggcgatgataatggccagaacaacaccgatcgcgcaggcataacccagatcgttcagccggtaagcggtgtcgtagacctgatacatgatggtcatggtggagttcagtggcccgcccttggtcagcaactggatcagcgcaaagcactggaaggagttgatagtcgtgataaccagcacgtagagggtggtaggcatgatctggggccacttgatcttccaaaagacctgaagcttggtggcgccgtccacttgggcggcctcgataagggactggtctacgttgcccagggccgccacatacagcacgatgggttggccgatggaggtggtaaacaggatcaggatgatgaaccagagggccgtgctctgggtgcccaaccagtcaaagccggtcgtgcccgccacttggttaaggatgccgttgtagggattcagaatccacttccacactaccgtgatggccaccgatccggtgaccaccggcaggtagaacacacagcggaagaaggagcggggaatggagtgcatcttatagatggcggaactcacccacagggagaaagcggtgacacagggcaccgccaccaccacgataatcagtgtattcaggaagcccttgtgaaaaatagggtcctgaaagagcttgatatagttctccagtcctgcgaaccccttgataccgcccaagccatacttcgtaaagctgtagaacaggcagatgaacatgggcacgaccacgaaggtcacgaaaaagatcaggctgggcagcaggaacagataggcggagatggtctctctccgcaccagggcgcggctcatgccggagaattgggactgcttttgctttttgggcttccgtccggcctgggccgtcacggtattttgcgccatgagtgtctcccctctttcaagtggtatttgcctttcctttcaccggtgtggtaaaaagaagctgtgcccgccccctctcagcagggagcgggcacaggtgtgcgcaattcaaatgcgttgatcgggctctcagccaatgtttgcgttggcctgctgcacaaagttgtcggccgcagtctgcacgtcagcgccggtggtcataatctcagccagcatgggccaccagtaaccgcgctgctcggtccagccgccggtcaggttgtagtagcggcccaggtagtcgctcatcagggcaaagggcgcgcgggtctcggcgtcagcgtcgccggcatagacgtcaccccagtcagcgtggacagggaagaatccagtggtcttcaccgcctcgatgccggtggtctggtcgtcgcagacaaactgcacaaacttcttggcggcctcaatcttggcctcatccttgttgttgaacacgccgaagccataggggccggccatctccagctcgggcttgccgtcgtcggaggggaaggccatggcaaagggagtgaactgggtctgctcagcatactgggtgtaattggagtagttccagcagaaggacacggcgcaggtctggttggcaaaggcctgcagctcgtcggccgcggcgaagctggcattggcggacatggaaccgttgttcaccatatcctgcagcagcttgagagccttgacgttgttctcgctgttagcgaggtaggaggtgccgtcctcattgacatagtagtcggagtacaggttgttgacgagggcgcgggtaccctggtccccgccttgggctccgcagtagatgatgccgggggtggcaacgttgacggtgcccgccgccgcggcgtcacgaacggcctccatggcttttacgaagttgtcggtgctccaggtgcgggtttcctcgtcgatatactggagggcaccagccgcctcaaagacatcatagttgatagccatgcagtgggcggccacgctcaggggatacatgtagtaggtgccgtccaactgagacacggaggagatgccctcggcaatgtcggagccgccagtctcccacaggtcggacagatccaccatcaggccctcacgggcgtagttgcccacgatacgctcggggccctcgaaaatgatgtcggggccggtgccagcggtgatggcggaggtcagcttctgatcaccgtcttgatagttgatgggagtgacggtgatcttgatattgggattctgctcattgaaagcagcaatgataggctcccaattggatgcctcggcaaacccaccgacattgaaggaccagaggttgagttcaacggtgccgctggagctgccgccggtctcgccgccgggcgcgggggattcactgttaccctgggagccgttgccgcaggcggccagccccagagtcataccggcggcgagcaggagcgcaagaggtttctttatgttcattgttcttcctcctcattttcgataaatttttctttccaggacatctcgtccgttgtgtagattgtataattccgagggtgttttgtcaatatgcttttcgaagaaaattttatttctccaaaaattctgcaaatttctttcacgttttgcaatacgcggtcaaatgtgcttgtctgaaagcacctccgccacggcctcccttgtctccgcactgccctgcacatccctgcggcacacctcatggaacagcacgtccatcaggtagagctgcgctacacgggccgccaccgagccgccctggaggggcccctccagagagccgcactgaagcactacgtcggcataggccgcaccgggggatttggggaaccgggtgaccaggatggccaccgctctccggtcccggatgattttcaggtttttcagcagctcctccgtggagccggagtaggaaaaatacagtaccacgtcccgggccgtcaggtgggaggcggcgatggcctgcatgtgggaatccagcaccgcgtagaagttgggccgggcggtgctgaacagatgggcgcactcctgagccaggatcatggaccccccctgccccatgcacagcaccttttccgcggaaaagagcagatccgccgccttccggacgctgtccgggcggatcagttccaccgtctgggccatggcatcccggtcagcggcgtagagcttctgacacagctcctcaatgctgtcttccggccggatctcccccggtacggtaggggcttccacccgccgtgccgtggagttggctacggcaagcttgaacgcgctgtaccccttgtaacccagccgcttgcagaagcgggagatagtggcctccgccacgccggcctcctccgccagctcggagatggacatgaactgggtcttctgctggtgaatcaccgcatagtcggccaccttcttttccgcgctggtcagctggtagtattcactgttgatcttttcaaatacatttccaaagggcataactgccccctcactgtccggccaggagctgtcccagcatctggtcacacatcaccagcatccgcggcaggtggaagggccccttgaacgtactgcccttacaggcgggcatggtgggcttgccgtcccggcgcaggtagccgtaccagtcgccgtattcgggatcggagaagtgctccttgcagtagtccagggtgcgctcaaaccaggtcaggtacttctcgtcgccggtgtcgcggtagatcatcaggctggcgatgaggatctcgtcgtggggccaccagagcttcatgtcgtgctcataggcctcagggggacgccccaggcagtcgatgaagtagagcaggccgccgtactcgtagtcccagccggcctcgatggcctggtcaaagattttgaccgccacctcatgctgcttcttgtcgcccttccggttggcgtcctccatcaggaaccaggagcactcgatgtcgtggccggggttgaccacccggccctcggtcacgtcgccccggaactcgccgttggggccgacgctctccaaggtgcagcccagctctggcttgtagtggtagcggaaaatctcatccacgcactgggcggcccgctcgctgtaaagcgcgtcctgctcggggtccacccggcgcaggaccgaggtgatgttcagatagatcatagggttggccagggcgcggccggagcgggtctctgggatggtcttggggcccatccccgtggggtcggcgaccagcccctggttcaggttccagatcaggtcgtaggccgcgcgggcccgctccaggcaggccttgtcgccggtaacaccgtaatactcggcgttggcgatggcatagaagccctcggagaagcaatagcggcgctgacgcagcggcttgccgtcgccggtgacggtgaagtacatccggttgcccgccgcccggttgatgcagtaccgctccatgaagtccaggcagctcttgctggcggccagccactcctccttcactccgtacacgtggcacagataagcgaagatccaagcgcagcggccctgcatccacacactcttgtccgtggagaacacctttccctcccgatccagacaggtatagacgccgccgtgcaccgggtccatgccgtttttcatccaaaaccggatgctgcgctccagttcctcctgaatccacttctggtgactctgtaaacgagccttatgatccataatgtcagatcccacctttcgctgattgggagaggtcccccattgcctccatcataaccgccctcccccctcccgtcaagagaatttcgaaaattattttcaaaaccctgaaaatatgcttgacagattcaaaaaaactgatagcctataggggaaggaacctgtctgtttcccacaaaaaaggagggcttacgcaatgaagcatcttggaattgaagtcccagtaaaaaacgtgccggaactggaccccggttttctccccctgggaaagttctgcaccgcctttctgaaggacgccaaaaagccgctggacatcgcggtggagcgggccggcggcgaggtggcggtctacaaaacctttatccacggcactccggacatggccgaggccgacatctactatgtggaccgcatcatcaagatgctgctctggatgaagggcggcttcaaggtgtacctcagcggcgatcaggccgtatatgaggccatgaaggccacctaccgcgtgggcggcgcccgcgcctttgacgccgacttcatgtccaacgtctatgagaagccctttgaggtggtgtactgcgaccaggtgcctgccgagaagagcaatccccaggctgtgggccgccacctgggcggctgccgcatcggcttcgatgctggcggctccgaccgcaaggtgtccgccgtcatcgacggcgagccggtcttctccgaggaggtcgtctggttccccaagaccacctccgaccccgactaccactatgagggcatcgtctccgccctcaaggccgccgccgagcacatgccccgggtggacgcggtgggcgtctcctccgccggcatctatatcgagaaccgcaccatggtggcttccctgttcctcaaggtgtccaaggaggactttgacgccaaggtgaaggacatctatatccgcgccatccgcgacaccttcggcgacgtgccctatgtggtggccaacgacggcgatgtgtccgccctggccggcgccatgagcctggaggaagacaacattctgggcatcgccatgggtaccagcgaggccgtgggctacgtggacgccaacggcaacatcaccggctggctcaacgagctggccttcgccccggtggacgtgtcccccaacgccatggaggacgagtggtccggcgacatcggctgcggcgtcaaatacttctcccaggactccgtcatcaagctggctcccgccgccggcatcagcctgtccgccgacctctcccctgctgagaagctcaaggaggtccagaagctgatggaccagggcggttcccccgccgaggccatctaccgctccatcggcgtgtacctgggccactccctggccctgtaccaccacttctacggcttcaagcacgtgctgctgctgggtcgcgtcatgtccggccggggcggcgacatcatcctggacacctgtaagaaggtgctggccgacgagtacccggaggtggccggcctcatgaaccccaccttgcccgacgagaaggcccgccgtgtaggccagtccgtggccgccgcctccctgcccgagttgaggtaagcggtgaagcgccacatcgtctgcctgggagactccaacacccatggatactgcgccgatcccgccgactgcgccgacggctccctccgccgctttaatgaatcagagcggtggacctgccgcctccaggctgccctgggagaggactttctggttcttgaggaggggctacccggacgcaccaccgtctttgacgacccggtggaggagagtttgagcgccctgccctacctctatccatgcctcatgagccacgcgccggtgtccctgctggtggtcatgctgggcaccaacgataccaaggagcggctgggcgccaacgcctgcgccatcggcaagggcctgcgccgcctggtgcggaaggcacagtccatcgactgctgggcgggcgggcagcccaaccttctgattgtcgccccgcccgccatcggaaagggagtggagcgatctcccgtggcccaggagatgggactgggctgcgtggaaaaatccctgcgcctgcccggccagttccgggcggtcgccgcagaaacccgctgccactttctggacgccaatgcccttggcttggcgcacaaccccattgacttcatgcacctcacccgtgagagccacgcccggctggccgccgcgctggccgagcggattcccacactgttctgaacccgtacaggcccggcgacctgtcgccgggcctgtgacaaaaaggaggccccttcatggccgcaggcatttttaatccggaaaacgacttctggcgtctgatcgaaaagctggtggatctctttctcctcagtgtgttctggctggtctgctctctgcccgtgttcaccctggggcccgccaccgccgccctctaccgcacagtggcgcgctgtatccgcggcagcgagcgcaagagctggagcctgttttttcgtaccttccgggaaaatttcaaggttggcgccctgaccaccctcgtggtggtggctgtcggtgcggttttgttcgttctctataccctgctctatcagactgcatcgctcaaccgcgccggctacatcctgtttatggcctactatgtgtttcttttgttgccgctgggcctgctgtgctacctcttccccgtcctctcccagtttgaattcggtgtgggcggcctcctctccaactgcgccaagctggccatcgcccacctgccctctacgatcgccctggcgctgctgctgtatgccgccctgacggtgtgtctcaacttcttcctggccatcgcagtcacccccgcccttctggccctgctccactccctccttctggagcgcatcttcgccccctacatccgccagcagttgggagaagatgacaatgacacttaaaaaaacagcctgtcgaatacatgcttcgacaggctgttttttgtttctatttctccgccagcagcttattgagttccgtcataaaggtgccgatgtccttaaactgccggtacaccgacgcgaagcggacataggccacctcgtccacctctctcagccggtccatcaccaactccccaatcttcgccgaggggatctcccggtccatgtcgttctggagaacctgctcaatttcgttggcaatctcctccagctttccaaagggcaccgggcgcttctcacaagcccggatcatgccgttgagcagcttgcttttgtcaaatgtctggcggctgccatccttcttgatgaccaccagaggcagactctccatggtctcataggttgtaaaccgcttatggcacgccaggcactccctgcggcggcggatgctggccccctcatcggagggccgggaatccaccaccttgctctccggatgggcgcagtacggacatttcatggtgtcttgccccctttgcttcattttaagctatgatggttcattatagcataaaagtgcagcccgtggtatccccatttgagaaaaaaatttccgtatgattttgttttttccgggtacactacaatcagcgaaagcgaggtgagcttgatgcagaatcagaatccggaccagatgaaggcccgcagccagaatggtcagaacaagaccaatggccagaatgctcagaacaagaagaaggagcaggctcagaacaagaacaaccagcccaaccagttctgactttgagccatgggccggggctccgccccggcccaatttttctttccaaatttttttcatttttctattgacattctgcgccattttggtataataacatgcgtgctcacgagagagcagtaaaaatagcgggtttgtgtaagggtagcacagcagactctgactctgtatgtgagggttcgaatccttcacccgctgccaaagctccgtaacctttcggttacggagcttttttttggtaaaaagcggcggcgcatccgaatggatgcgccgccgctttatccacgtccgagggcgcggttttgaatatggatagcctcctcccgcgccccccggtcaggtgcggagagttcatgtaccaaatagtccggcccgatgcgctccactacctcacagatggcaggggaagtccagggctgatgcgtatcgatgcgcaggatatggcggtagccgaagccgtaccgctttaaatagtccagaggcaaccccggaggaagaaaacccgtatgggcccggacatattccccgctgagggagcagtgaagatgaatccccctgatgtaccggcaaagacctccatgccggtccagcatgcggtgcacatagtccgccccttcctccagggtacgcaggctggtgtcgcagttcatcagatgcccgatatccagcatgatccccttgcgctcagcccggattccgtccagcagacggcgggtcagctccggctcggtgaaggtgaagcccggccaccactggttctctaccaggaagtcgaagggcctcgcccggtctcccagcaggagattgataacctccgccgctgcatcgatgacctcctcatgggtgtgccgccagtggtaagtgaagccctcctccaccgacacgtcggacacgtggaacaccacatagcgcgccccccacgtcacagctcggtccagatcctcccggtagaggcgcagcagggtctcccgtccctccgggccgccgtaaaaggaccgccacacttcctccgagccaaatttctcggtcagtgcggcccggtctccccgccagaaatccagccaatctggataaaaggtcaggtggtagcccacgtgcagcgcctgcggcaccgtgcaaggcagttcctcaccgccccataccacctccaggccgtcacagccgcaggaacggcaagcctcctccaagtccccatactccgtcaggacagaggcggtcatgggcaggctcatcagggtatccatttatttgcttccagtgttgaagaatggggccagcgccgccgccaccccgctgaccggcatggtctggagcagaatcttgcccggcccggttaccacggtgttgaacaggccctcgccgccaaagaggacattcttgacgcccttcaccatttgaatgtcaatggtgcaggtggcatccatcatggctaggttgccgctgtccaccaccatgctctgccccgcctggagctcatactccaccgcatagccgtcgacctccagaaaggccgtgccgcggccggagagcttctgcataataaatccctcgccgccgaaaaagccagctcccgctttcttttgaaagaagatggacagctccaccccctgttcagaggccagaaagccgcttttctgcaccactacggggtgggccgggtcaatctccaccgccttaatggacccagggaagctggaggcaaaggcgatcatcccagctccgccctgggcggtataagtattttgaaacatcgactcaccggagaacatgcgaccgaaggctttgccaataccgccggctccggtttccatcttcatgttggggctcatccacaccatggagccccgctcggtgatcatggcctcgttggcctccagatcacacaccacaacgggcatgggctcaccaatgatctcatacttcataatgggtccctccttatgtttggatgctcctagtatattacggtttccgaaggatggcaagtcccgccccatgcactttacaaattctttcctttcgtggtatgatggtactattctttcaaggaggcgtcggaccatggagctgacaagggagcaggcgctggccctgctcaggcagtataacgaggagccctttcacctgcgccatgccctgacggtggaggccgtcatgaactggttcgcccgggagctgggttacggggaggaggcggcgttctgggcccaagcggggctgctgcacgacttggacttcgagcgctacccggaggagcactgcgtcaaggtgcgtgagatcatggaggcccgcgggctggactcggccctcatccacgcggtagtcagccacggctggggcatgacggagggcgacgcccagccggagcacgaaatggagcgggtgctcttcgccgtggacgaactcaccggactgatcggcgcagccgccctcatgcgcccctccaagagcgtgcaggacatggagctgtccagtctgcgcaagaaattcaaggacaaaaagtttgccgccggctgctcccgggagaccatcacccagggagcccaactcctgggttgggagctcaacgacctgctggagcgcaccctccaggccatgaaggcctgcgaggcggacatcgaagcccagtgcgccgccctctgagatccacaaaaaaagaccgtgtcccccggcggggatacggtctttttgtcaagcgtcggtggcctcggtggcaatgcccgcccgctcctgggcgatgttcagtgcgtggtcgccgatgcgctcaaagtcggtaagcagctcggagaaaatgatgcacgcctcgtctgagcaggagccctgcttcatccgcttcatctggttgcggcgatactcctcagtcatgtcgtccatccgctgctccagcgcggaaaccttggtgagccagtcggtgggctcgatgctctcctgctccagcagatccagcacctccaggcatacggcctccatggtcctcagttcctcctgagcctcctctgagaattgaatcttcttcttgtccagcatctgggtgtactcgcagatattcatggcatggtcgccgatgcgctcgatgttgccagtgatcttgaagtaggcgctgattgcggtggagtccttctcgttggtctcgtgcacgatgatgttggagatgtactgggagatctccttgttgagatagtcgatatactcctcggtggcctccgcgctctccacgcgctttacatcccgctccagcactgcctggaagctggtggcgatgttctccttcgccatgcccatcatgcggttgagctcctggcggatctgggtgacatacatcgcggaaaagccgatggggtgctcctgcttggaggcaggcataggcaccagaaaagccaggtgcatcccctcctccttgtcttccttgcggtcgggcaggatgcgcatggcgatcttcaccagatatccgccgaagggcagcagcagcagggtggtcacaatattaaagagggtgtgcatgttggcaatctgcgccgccgggttgtcgggggtcatggactgcataaacccggtcaacggcgtggccatgcagatgacggtgaacagaacggtgccgaacacgttgaacatcaggtggatgatggtggtgcgcttggcgttgcggctggtgccgatggaggccaaaacggcggtgatacaggtgccgatgttctgtccgaagaggacgtataccgcgctgtccaggccgattaccccactgagggccagcgcctgcaggatacccaccgaggcggaggaggactggatcagagctgtgaaggccgctcccgccagaatgccgacaacggggttggagaaggtgctcaccagattgacaaaggcgggccattcccgcaggggctccatggccgagcccatcatctccataccgataaagagcacgcccaggccggccagaatatttccgtagtggtgaatctggggcttcttcaaaaagaccaccatggccacgcccacaaaggcgaacaggggagccacggcgcccacgtccagggcgatgagctggccggtgatggtggtgccgatattggcgcccatgatgatccacaccgcctgtttcagcgtcatcatgccagagttgacgaagcccaccaccatgacagtggtggcggaggaggactggatgaccgcggtaatgcccgcgcccaccaggatgcccaggaagcggttggaggtcagccgctccagaatgcccttcatgcggttgcccgccgcggcctccaggccggcgctcatcatctgcatgccgtaaaggaacagggccaggccgcccagcagccccaggagaatgcttatgtctaggttcacgttcattccctcattttttacattcttttttctgatctcttaccaaatgccagcagtagtataccgaatgtaaagtggcgcgtcaacggtatttacaagaactttacaaaaagattcgaccggatctttactcttttttaatcttccaatttccggccagccgttgcctttcagccgattttaggctatactacccttatcccgttcgtttggcctccgggcccgcggaacaaaaggagaatgtttttatggaacagcaaccggccaagaagcgccgaggccctgcaagcaagctggggaagatcctgatcaacctgatcgtcaccgctgtggtgggcttcctctacttctatgtggccctgccccccatcaacctgcagtccagcgatttttataccttcatcggcatcctgtgtgtggtgtatgtcgtcagcgccctgatcacctccggcatgaatgtggtcagcagcggtggaggccccaaggagtacctccgcttcatcaagacccagtgcctgcctgtgggcatcctgtttctggccctgatcgcggtggccatcgtgggctccgtcctctcgatgccccttttccgcgccgcggcctaccgggatctgctcaccgtggaggatggcaatttcgccgaggacatcgccgagatttcctttagtgagatccccaccctggacaaggactccgccaacttcctgggcgaccgccagatgggcaccctcagcgacatggtcagccagtttgaatactccaacgactccacccagatcaactaccagggccgccccgtccgggtcgcccccatcgcctatgctgacctcatcaagtggttcaccaaccgctcccagggcctgcccgcctatgtcatcgtggacatggtcacccaggaggccactgtggtgcgcctggaggaagggatgaaatactccttctctgagcccctcaaccgcaacatcgtgcgccacctgcgcttccaataccccacctacatgttcggcacgccccagttcgagatcgacgaggacggccgcccctggtggatcgccccccgggtggtcaagaccatcggcctcttcggcggcaccgacatcaagggggccgtcctggtggacgccatcaccggcgagagcacctactacgaggaggtgcccacatgggtggacaacgtctacacccccgaactcatcatggagcagtatgactaccacggcaccctggtcaacggcttcatcaactccatctttggccagcgggacgtgaccgtcaccacccagggctccaactatatcgctctcaacgacgacgtttatatgtataccggcgtcacctcagccaacgccgaccagtccaacctgggttttctgctgtccaaccagcgcaccaaggagaccaagttctatacggcgcccggcgctacagagaaggccgctcaggcttctgccatgggcgtggtgcaggatcttgggtatatagccaccttccccctgctgctcaatatcgctggcgagcccacttacttcatccccctgaaggacaataccaacctggtcaagagctacgccatggtcaatgtggcccaataccagatcgtggccaccggctccaccgtctccgagtgtgagcagaagtatgtccagctgctgggcagcaagggcatcaccacgccggaggagcggccgcagaccgaggccagcggcgtcatcgccgagctccgctccgccgtgctggacggcaacacctactacttcatccgcctggagggcgaggaggtgttctactccgtctccgcctcccagaatgaggtggccgtgatcctcaatgtgggcgactccgtcactattgagcacgaggtcccgcaggagggcagcgagtcgctcatcctggacggctacaccatcaccagccacaccagaggcagttctgccgttccggcggagccctccgcctcccccgagccgcagaccggcgcagccgcatgacacagcgggcggacagcagtgctgtccgcccgctttttgcgaggtgattccccgtgattctctccgtctcccgccgtaccgacatcccccgctggtactccgagtggctcctccgccgcctgcgcgccggcgaggtgctggtgcgcaatccctaccgccccggccagctccgccgggtccccctctcccccgcagtcgtggacgctatcgtgttctggacgaaagaccccgccccgctgctcccctggctggacgagctggacgggatgggctaccgctatctgtttcagttcaccctcaccccctacgggccggagatcgaaccgggcctgcgggacaagcgggccattgtggagacctttcaggtcctgggctgccgcctggggcgggggcgggtgctgtggcggtacgaccccattctgttcaccgacgccatcggcctcgcctggcacgaggcccggttccgcaagctctgtaaagcgctttccccgttcactgatcaggtgacggtgagctttctcgacccctaccccggccgtcccatgggcggcctgcggcccccaaatgccctggaaatgcaggagctggcggccatgctggggcaaactgcaaaggaatatcacttgtcaattgtggcctgctgcgaggcgggggacttctccgcccacggcatcggccgggccgcctgtatcgaccgggcccggctggagcgcctgtgcggcgggccgctgcggctgggccccgaccggggccagcggcccggctgcggctgctgtgaaagcgtggacatcggcgcctacgacacctgtccttccggctgccgctactgctatgccaaccgcacccccgcccgcacagcggcacggcgggcggagcacgcccccgacagccccctactgaccggcatacctagccccggagataccgttaccgacctgcccgcctgctcctgccgcgatgggcagctccgtctgttctgaccgtcatccagccgttcagcagacccagggcctcgggcgacaggagcagcagggcgcacaggttgggcagggccatcaggccgttgaagatatcagctaactgccacaccacggccacgtcgcctacgcttcccgccaccacggccagcaggaaagccgcccggtagggccagcgccagcggtcggtaccggtgaggtactggaggccccgctccccgtagtagctgctgcccagcagagaggtgaaggcaaagagcaggaggcagaccgccacaaagaccaccccgaagcggccgaacacggtggagaaggcggcggcggacaggggcgcgcccaccatggcgctggtgacggtgccgctctgaatggccagcagggccgcattctcctggtacaccccggaggtgaggatcaccagggctgtgatggaacagaccgacagagtggcaataaacacctcaaaaatgccccacatcccctgctctgccggttcctgtacgttggaggcggcgtgggcgatggcggaggagcccatgcctgcctcgtttgtgaatacaccgcgggccacgccgtagcgcatggctgcggccatgccgtaccctatgccgccccccagggccgccttgggggtgacggcgcccgtcacgatgcgctccagcgcctcgggaatggccgcccggtggcagatcagcaccatcactccgccgccgataaacagaagggccatgcagggcaccagggtttcgctgacccgcccgatgcgcccgatgccgcccaggatcaccagtccggtcagcacggccaccaccagtcccaccgccagccggtcccagccgaaggccgcctccagggaggcggcgatggagttggcttgcaccacatttccgccccccagggaggcggccacacagcacagggaaaacagggcggccagcgtccggctgcccactccccgctccatgtagcacatggggccgccctgccagccgccgtctcggcttttctcccggtagcgcaccgccagggtcttttctacacatccggtcatcatgcccagaaaggcggacacccacatccagaacaccgcccccggcccgccgtagaagatggcagtagccaccccggcgatggagccagtgccaatggtggaggccagggcggtggacagggcctggagctgggtaagccccccgccctcccgccgcctcttcggacggagcagggagcccagcgtggttttgagccacagccggacgtgaaagagctgaaagaagccggtccgcaccgaaaaatacaggccgctgagtaaaaagaggcccagcagccacgggttccagataaaatttcccaatcgctcggcaaaggccatgtccacacccccctgttacacatatgccggaggggggaggaacatgtctcccttgtcaagggcggttttcccctttataatagggtcaaaaggagggcgacatcccatgtttgacttccagcagatcagccgttaccgggaaaacaaccgcctggaggccaagctggccaccggcgggctgcccaggagcatctgggagacctattccgcctttgccaacacctacggtggcgtcatcctgctgggggtggaggagctgcccgaccacaccctgcgggtgcaggggctgctggagccccgggagctggtggacgagtttaccgccctgctccagaacccgcgggtagtcagcgccaacctgctcacccctggcgacatccaggttctccacgtcgacggcggggatatcgtggccatcacggtgcccccggccgagcaggaccagcgcccggtctacatcggcggcgacctggcccgcggctcctaccgccgcagcggcgacggggactaccactgtacccgggcggagctcaacgccatgctgggcggccgctcccactgacagcaggcccccggtcacccagcggccgggggcctgtcagatttgcgccagcgcgtccagcaggatatggctccactcctccggccgctcccggaagggcaggtgccccgcgtccggcagggagagaaataccttacagggggccgacagggtatcgtaataggccgccgccaatggatagggcgtggtccagtcccgttctcccgccgtcaggatgaccggcaccccatagcgcggcggacaaccatccagggacaggccccccagcagctcctcgtagagggcggcattggccgccagcatccggtcaaagcggagcttccaccgcaggtcgtttccggtcagctccggggcggccagtccccccagcggagacggcccgccgtactggggcggcagataccgctccttccgccggcgaaaccgcagcagggctccggcccccgcccggtccagccgccgcagggccagcacctgctccagctcctgcgccagcctttccgcgtcctcctcccgccccgccccgcgggcccttcggatggcctccgccgccgatacctgctcggaccgcttgaagtccaccatctggctgacggggagccaggctgagagcttctccgggcggcggagcgcatagagcccgcccagcaggcttccccaggagtggcccagcaggaacagcctgtcccggccataccgggcccgcagggcgtccaccagctcgtccaggtcggagagcagccgctccacagtgggcggcggggcggccgggtcccggtaataggtgttcccgctgccccgctgatcccaatgaaccacggtgaacgccgcctccagcgccccctgccaccggcaggcggtggcccccagggtgctgcccggcccgccgtggagcaccagcaggacgggattggcacggctccgcccccggacgcggatatactgctcgatgccgccgatggggaggtaagccgcctcctgcaccccgtccgccgtgcggatggcgtaccgcccaaaccgccccggcctcatggagcctcccccacggccgccagcagctcctccacgcatctgcgctgccgctggacgatgtccaccatgttgtcaatggtgatgcgggccaggggcggcacctcctgtccctcattgccggcgcggccccgctccagggcggcgtactccgcctccagccgtcgccgctgctcctccagggctagccgcacctccgccggaggcagcttgtctgccagtgagagggcgctgtagagtgtggtgggatagagggcggaggaggcccgcagggcgtcggcgatcagggtgtgcagatggttccggcccgcctcggtaatccggtagaccgccttctgccggtggcccgtctgctccacccccgccagggcgatgcagccctccccctccagctttttgagcgcgtggtagatggagcccggaagcacgccgccccaccgctccgcgtccgccccgcccagcttctgctggaggtcgtagcccgacatgggccccccgtccagcagtcccagcaccagaagttttgtcatagcgtctcctcctcggtctatattcaacattgagtatacaacaaagaatatatttgtcaagaggagacagaaacgccgggcggcccgtttgggccacccggcgtttctattttacaggttggcgtccagcactgcggtgtagctggcctcgggcatcacgcccaccttgcggtcgatctccttgccgtccttgaggaaaatcacggtggggatgctcatgacgccgaagcggacagccagctccggctgctcgtcggtgttgaccttgcccaccagcaccttgccctcgtagcggtcggccaggccgtcgatcaccggagagagcattttgcaggggccgcaccaggtggcccagaagtccaccatcgccagcccgctggcggtggccttgtcgaacgcctcgttggtcagatgaatgagtgccataatttgttccgtcctttctctgtatcgccttatgatgaattagagtgtgtctacgtattccgatgcccggtggcccgccacctggccctcccccacggccttggacacctggaggggcaggccggtacagtcccccgcggcgaacacgcctgggaggttggtggccatgttccggtcggttttgatgtaaccgccctccagcgccaggccggggagcaggtcggcgggggccatagaggggcggagaatgaacacgccctcgcaggggagggtcacgctgccggcccgcagggcctccaccttcttctcccccagcacctccagccgggtggcctttacaaaggggatatcggggcgcagcccctccggcggctggtcgccgacgtaggtgacccggcaccccagctcccgcaggtagttggcctcctggggggcgtcggcggttttgcccaccactgcgatctccctgccccggtagagcatcccgtcgcaggtggcgcagtagctcacccccgcgcccagccgctccgcctcgcccgggtacttcttcgcccgcaccacgccggtggccagcaccacggcgcgagcctgctccacctcgctgccgatgctcagatagtatgcgccgcccacggccaggagattcagcacccggccgtcccgccgctccgcccccatctgtccggcgtgggtgcggaagcgctccagcagttcgggaccggtcacattgtaaaaacccagatagttgtcgatgcggctggtcttgtagaggggattgtcccggtcgtccccgctgaccaccagtaccgacttgttgcgcgccctgacctggatggcggcggacaggcccgctgggccgccgccgatcaccgcgatatcatacactggtattcctcctcccggtcgccgaagagggcggagagcaccgccgccacctccgggttggcaatttcatagtatacctcgttgcccgaccgggcggccttgaccaccccggcggccttgaggcgcatcaggtgctgggagatgcaggactgggactggccggtgttggcctccatgcagcccacgttgcggcagccgcacttcagcagcccgcggacgatccgcagccggagcgggtgggccagggccttcagcagctccgccttctcctcatagagggcggtgggatcgctcatatcgctcacctcatcgtcagtttctaatattattatattcaaatattctaatatgtcaacccctttttccaaatttctcttgacagtttggccgcctctgtttatcatggtaattcgtttggctatcaaatcattcgagcgtcaaacaagcctacatcagaaaaggagctcaaccatgcacgagaccacgaccaagcgccccggccgcgccgggaaatacattcggcgggccctgctcgccctggcggcggtgattctcgccgccgtgctggtgctgctggccctgttccaagccgagctgcgcaccctgaataccattgagcgggtggacgacaccgacctgttcaccatgacctatctgggagactacggcctggacgactttctggcccagggcggcgcctccaacgacaacgagctgctggacttcctgatgcagaagctgctcaagggtctccccctgcgcttcgacatcccggatctgggctgctccacctttgccgccgagaccccggagggcgacgccatcttcggccgcaactttgacatgtactactcccccgccctctttgtccgcaccgctccggaggacggctaccgctccatctccatggtcaacctgtcctacatcggctttggggaggacaagctgcccaccagcctgctggacagcctgctcaccctggccgccccctatgtccctctggacggcctgaacgagaaaggcctggcggtgggagtgctgctcatcgacaccgagcccaccgaccagcagaccgacaagcccgacatcaccaccaccaccgccatccgcctgctgctggatcgggcggccaccgtggatgaggcgctggcgctgctgcgccagtacgacatgcacgcctccgccaactcctgctatcactttcagatcgctgacgccgccggccgcgccgtggtggtggagtacattggcgacgagatgaacgtggtggagagtccccgggccaccaactttctgctcaccgagggcgactgggacttcggccggggccaggatcgcttcgccgtcctggaggagaccatggaggccagcggcggcgtgctcaccgaggaggagggcatggccctgctccaggcggtcagccagcagccccagcccggcaaggacagctccacccagtggtcctgcctctacaaccaggtgcggggcactgtggacatcgccgtggccatggactatgacagcctctatcacttcgccattgacgaataaccggcacaggcccgccgcatatgcggcgggcctgtgctttttgttttaccgaatcccccagaccagcaagctggagcgccccacccgccggaactccacgccgtggaagtggggttccagcagggcggccagctccgccccgctgtagaggcgcacgtccccctcgccggacagggggaggaacaggttggccaccccccgcagccccgccggggccgtgcagtctcccagcaggagcacgccgccgggctggagcacccgggcaaactccgccgccgccgcgcccgggttgggatagtggtggaaagagtcgttgcacagcagcacctcaaaccgcccgtcggcaaagggcaggcgctcggcgtccccctgcaccagctccaccgcgccgcccagcttttcccgggccaccgccagcatattggccgacagatccagccctgtccgggcggtctccggaaaccggagccccacctcccgcagcagctctcccgtgccgcagcccacgtccagaaccgagccgtggggaatctggacaagctgctccagcaacaccgggtacagcccacgggcatggctgccgaagcgggcggtgtcataggtccatgcctgccggtcaaaggctcggccagagcgcgttttacagtcgttcatcgcacattctccttattgaattttattcattgaattttgttcattcgaatggaaattttttgcctccgacgcgcgtccccgcgcttcggaggcgttgttcagtattccggctccagaatccggccggcatagcgccggaggagcgccacccgctcctccaggggcaccgcatgttcccccagcaggccgatctgcccgtggagcagatagctggccgccagggccggatgctccaggcgcagctctccccgttgacaggcgtcctccagctcctccgccacatggggcgtcagataggcgcagatgcgccagttcagctcctcatggatgctctggttctccggccggtggtaaaaggcgtggtaacgggcgttctgctcggtctccagcgtcagcgccgccatgtcgtccagccgctgccggatcgtgcggctccggtcgtggatgatgggcagcccggcggcacagcactcccgaacatactgctccatggcctcccggaacagcacccgcttggagtcaaaatagcggtagcacagcccctgcaccacccccatccgcctggcgatgtccgccatggaggtgtcctcataccccttttccgcaaacagctccatggccgtatccaggatctcctgccgccgtacctccggcggctttgatatccgcgccatcccatcacctcatccgcagtatagcactcgattgaacaaaagtcaatgaataaaattcattttgagagaagccgcttgaggcccgcctcatccagcaggttgaccgtctcaagccgcccccggtagaacaccgcccagttgttgaacacgccgggcaactccttggccctctgcaggctgtccaccgggatcagggtcaccggcgcgcccctctccccgcagaagcgcttcacctgctccagactggcgtgaatgtaggggcactgcatgccgtaatagatggtcagctcctgctccgggatcgtcccccgccgggcggcatccgtgaaccggggcgcggtgccgtcaaaggagagggccagcagctcataccctccggcggcggtgtccaccacctgaaagccgtattttttcgcaaagctttggtcggagagccaggccttctgcttctgggcgcccagcatgcagacgcccgacttccccttcgctccggcgtccgccaggcagtactccatcagcgcccgcccgcagccctttcccttgtacgcccccgctgcccacaggcagtacaagtacaggtagttgtcccccgtcacggggacccaggcggtctccagcggggcatactccacaaataccgcccccttctcgtccagctttcggaagacatgcccctcctccagccgcccggcaagccagcggcgcttggcctccacccccggatggggcttcctgctgcggatgatgcagcacaggtgctccccgtccaggttttccggcgtcagattgataaactctttttccatagtcctcccccggtttaattccaccaaaagtaccagagctccgactttgccaggccgtccgccaggatgccgatctgctccacgccctgatccacaatgtccgggcaaaagccctattgctccagcgtcagggctatcgactcctcccgggccatcgggcggggtaattggcactccagcgcgtcgtgggtgacggcgcagggtaccgctccatgccgctcctgtcagtaccgcgccgccgcctgctccggcgtgacgccatgtactcccccctccggctccaggttcatctgcaggcattccagcaggggatcgtcatcccacatgggtgcgaaataggtacaaggacagcctaacagctccatcatcgcccgggccaactccgggggtgtccgcttttcttccatcactccggctctttcttcatactctctccgccaaccgggcggccccccacgtattccaccgccggtccagataggccttcattccgcggtcatgacagttaaacaaaaaacgcccctcctgactcagcttcttttgaagtgcctctcccatgcgcccccctttggtttagtataccacatatcactcaaatttccgacaccgttagcaaaaaagaggcagaaaccaattggtttctgcctctttttggtggagataagcgggatcgaaccgctgacctcttgaatgccattcaagcgctctcccgaaccatcgggtatgcaccccctgatggcttgggaaagggcttgaatatcccgccccggcaattgatgagagacaagttgcagtatagcatagaaggtatatgttgtcaactggacatacctttacgatatgtacccctcgccgtggtcgtggcgagggtgagagcttattgcgccatgggcagttcataggtagcgcattcgtcgatgctgtcgataccattcaggaactgctccacattaatgttgaattcaatcttgaccctatagtcccggaacaccgaaaccttcttgatgatgtagccgcagatcattttcttgacctccatcgggctttcatcgaaaatcttggaccaggacacgatccggttgaactcggccttcatctcctcgatcttagagtttccatcattcagttctgcggtaagggtcgtgattcgttcactggtggacagtaccttctgtcgggtatcctccagcatttcagtcagcacatcttgcggcagggcgcttttcccttggatcgccttcagcacctcggacttgagggattcatattccttattggccttggtgttttcggctctggcccgctgcaattccgagcgtatcattgccatctgcttttgaaccgcacttcccacaatcatgtcgttggaagctccctgcatcttgtcgaagacctgatgcagcacctcagtgacgatcccgtccagaatgtgcattgtgtatccagtctgtcctgtgcattcctgacggcgccgggtcttgttgtagcatacatagcgaatacgctttttatggaccggcgtcccatccgcgaggcgggtggttgtcccgttggtagtgagcaccagccggcctccgcagtgtccgcagaagatgtttccggaaagcagggattggcctgcggtattcagcggtactgtgcgccgctctttccgctcattggtccgctccagcatcagtttctgcgccaggtcgaattggtctggggcgatgatctggagggcttcaaaggggccggcataggtttctccgctccgaaggattcccttgtagagcgggttgtgcaggatgccccccacactggcgtcgtgccagttttgtcccttccggtttttgatcccgtggtcgttgaggaagttggcaaggcgccatctgccgtaaccggacgaaatgcagaggtcaaacatcatccggacgactctggcctcgtcctcatcaatgaccagcatgtacacctcatgtttgcgcttgttgaggatgccgctcttttccagccggtacccgtatggtgcgtttccaccgcggaaccggccttcctctaccatctggccaagggccgttttggtgcgcatcgaagttttctggctctctccatcggcctgccagaaacggatgtagttggtcaggcggtccgtgtgggactcaaaccgctgctctccttcctgtacgctccagacgcggacgccctttttagtaaaccactccacaacgaagggtgtttcatctgacttgcggcccagtcggtcgaacatgaagacaagcagaatatcgaacttgccctgctctgcatacttcttgatgagctgcagtttatcacggtcatcggcgctgactttataaccggatacgccagtttcctgctcctcgcccacgatgacccagcccattttcgccgcaaaatcgtggcaggcttttctctgcatagggatgtctgcctggttgttttcatcgtgatcgacctgcttgttggtggaaactctgtatagacaataaactctttcagccattgatatccgtcctctcatgtttttgtgtgagagggcggacacccaatcattatattcgattatcaaggttcccagctttcgccatacccattatctcacactacggccagaatagccaggggaattgataatctttttggaggtaaatctgcagtaaatgggctggtgtgttgggttatcctgtactttgctcaaagtttttggacctcatcagtctgccaaaagcgaatgtagtcaagcatgcgttctgcgtcaacgccgtctatgatctctccctcatagacgctccaaacatggatgcccttcttggtaaaccactctgcgatgaatggggtttcgttgagattgcgtcccagccggtcatacataaagaccagcaggatatcaaactcaccctgctcagcagcctttctaatgcgctgtaacttaacacggtcatcagcgctggctttatagccggacacgccgatctcctgctcctcgccaacaatgttccagccttttttctctgcaaaatcgtggcaggcgttcttctgcatgagaatgctttcctgatccttacctctgtataagcaatagactctttcagccattttactgaccatcccttcatcaaattttctgaatgcaaaaccttcggcaagtcgttctatttccggggcattgcataggcgctcaggagcgcctgctttaccaatacggcaacttcaggattttccttttctgcaaagcagagagtgaccttatagtcttgaactgtgatgtgcatttcaggcttttcttcgtcgattctgagtatccggttcatagtaaccctcctaaaaataaagcatcggctattctaaaaagatagccgatgcttctcaatttctaattgtagctgcttagtggcgatagtccttttacagagtaggttcgattgactgagtaccagtttcctgtgcttggacgatgtccaatgttggcagagctttcagataattctctacattccagtattgaaccccattttccatctgcacatcttcgccacggtacaggatatagcgtccctggatggagccaaatcgccgttctgtcctccggcatttatcctcatcgacgaggtgccggtattgaaggggaacttgcttgctgctgtgtttgatttcaaagatctcacaggagttttctttctggtcataaatgaccatgtcaaactcgccagcctcaaactgcagtttgaaaacacggtgatccttgtcggccgccttcatggtttccagcagcacaatatcttccatcatccggccgcggacttcttcaaggatgcggcccgtgatctgcgttttgtcatattcgctgagcgctgagaactgctcatccttcaacaaggaatggacaagggcctgagcctgacaatatcgcattccaggctgtgtgaagagaatatgttccactggttcggttccggggtccgccgcttcaatgggacaatccacaatcaactccaatgcggcaagatattgcttaatctctatgatgtgagcagttgtgataccgatggactgctcctccttgttccggatatccagcagttccatcaaacgccgggtgaccgcctctgtatcaatggcatccagcgcctctgtgcgcttttcggggtcacgctctttccgcagatttgcggcagtgagccgcaggtcatgggagagaaaatcatcggtcagcactgagatcaggaatcggtggttcatatcctctatgatccggttgatggcgctggtcagttctccagcttcatacagagagtacaggtggcggaaatgcccgcccgactcgtagcaggccagggagtgctggatgttcttgcagattgccgtatcgatgtatcttcgggtggactcgtcatcccggaaggatgcatcctgagcattcacatcttcatcgtcaaaggccaactctccggcgcgtagtgtgccgccatatcggatgtactcatcaatgctgtcgatcccgagcagacggctatactcccggtatgggatgaaggtcgtgtggatgggcttggcccggtcgtacaattcttcatccatcgccagccagaagcccagggagtccgtaccagacaggacgatcttcattcccatggtggcgaacacatcggaaaagagggcagccgagtcaataaagtcctccatcagcgtgacctcgtcgatgaacacatattggaatccagcgtcaaacagcttcttgagatcccggttcatcatcgccatattgtcagtcctgcgggctttgatataggcggtgcggctcaagtcctcctttgtcattctgccgatggcctggcggagcatggtcgtctttccggttcggcgcaggccgaagatcaaacagacgcggtcgctctccttgctgtagagatactcttccagttgctcaaagcaatcacgaagtccccagtcctttacaccctgcgacatggcctccagacccctgccggcaatcacgctggtttcaaaatccaacttgggctggcgcgctttcggcatgccggattgcagttccttcagttgagcttgaagagacttgcgccgatcaatttgttcctgcaatacctccatctctccatctcgaagatattggctgtgcttttttctgttctctgtccactgatggtagtatcggactttgccgttgatcgtcttctttgagatgtaaccaatcggcaggccagcgatctgtctttccagctcctgaatcttctccagttgtttcaactcgtccatgtcgcacctccattctattgtattttattataccctataaccccaaaacattcaaggggttataaggggttacacactcatggtagattaaagaagcccacgaatgcactcgctttccagttcaacgatgtcgcctatcggtatccttaagccatcagccagaaccagtacctgatccgcctcgtgtattcttttcagcctcccggttgatacgatataccggccgccgtctttcttcgcgtcaggctggaaccaggtcaccgtgatttccggccgctctttgatccgctccaacagcagttgctgttttaagtccaaggcagccctggtatcctcgtccagttccatgcgctggtcggtcagccgggccgtttccgcaagggcggcgctgtggccggacagggccgcaaagggcgcgaactgggccgcacggtctgagagcggcatcctcgggtgcttggctgaggtaggatgcggcaggctgatgatatcatcgtatggtccggtcatgctttgtggcctccgatttggttgtttctctctctggctgtggcgccgtcctccaggttcatccctttgaggatggcgttcttgccaaaacgctttttgatgcccagcatggtttcctggagttttctctcccgtacatgggcggcgtcagcctcttttttctgcttttcctttgccgagtagtccgtaaacaggtcgatctgctccggcagatcctccggcacagaagactcgtccagcaagtgattggcacagagggtcagccggcgggccagcagggttttatctacaatccggtcatacaggctggtggctgccttgagcagctcctcgccggaggaggtatatccgtccagattgactgtaccatgagcatgctttggaattttgcgcccatagcggtctgtggtgacctctccggtgtaggctgtacccttgaggttttcgatgtcatagccaaccgtgaggaccagttggttggtcgcaagccgcttatctaccaattccagcgccagtgcatcggccatctcctgaatgaccagctttgccttttcaaatgggtatgggtactgcaggatctgcccggagacgatgctcttgttttctggtttgtatgccttaatgtccgcaatggtgcagggttcccagccccaggcatggtcaatgagcaactcggcgtttactccgaacagtttatagagtagttcctcgttgtgataatctgtaggctgcccgatagaacaccgggcaatatctcccatggtgtacaggccgttggcttccagcttggcggcatagccttttcccaccctccagaagtcggtgagcggacggtgggtccagaaggagcggcgatagcccatctcatccagctctgcgatgcggacgccgtattcatcggcggggacatgcttcgcgccaatgtccatggcgaccttggccagatacagattcgtcccaatgcccgctgcggcggtgatgccggtcgtctgcagaatgtcgaggatgattttccgggcaaattcacgggccgacagacggtaggtctgcaggtagctggtggcgtcgatgaacacctcatcgatgctgtatgggtagatgtcctccggcgccacatgcttgaggtaaacactgtagacgcgggtgctccagtcaatatatcagctcctctttttctgcatctgttttctcaatccaatccagcagattttgagtttcaatcaggagcatggccatgtcaaacagggatctgcgttcaggtgcggtttccagtaaggtagaggtttcgaagagatcctccagcacctcgatactctccagcccagaccagttcaggagcagttcctgcctgatatgctcggctggttccccattttcgatgcggcccatgactgccttttcctgctcaatgagagcaagctgttctgatgtttcctccgcagtcagtcgccatgctttcccgattaggctgactgcctgctcatagggcgcagtttctgctccgcttccggccagcgacagcatagcagcggcctccagcgccagcttctcctgaagctctctggctcttgattgatccattttgttgcctcctattcatttggtgttttggcggtttgcccgacaacacaatgccacgctctggtttgaaaagctattcaccactaccaataaaatacaggccgaaaaactgtgggaatcggcaaaggctgccgaatggtgctgcctacatccggatctccattccttcttccgcctgcgtttgcagcaaagcggcccttgcttcctccaagctttgaccattctgctggcggcagtaagcgtccatcttatcccacagctgggcctgttccgcgggagtcagcgggtaggaaaactcaaactcatgaccgtcagagcagacgagacatacagtcaatgcgctgtctatccgcccggtcttccagtcaaaattggcgtacacattcagccagtcatcgttgaaggcggaggcaacattgataccaaatacctcgtccggatcaaagtttatggggatatagaagttcagtttcccatcgcactctgtgatctcatcgctaaaggacaccgcatctattgacagccttttgatgcctgcggtgagttcaggaggggtttcacgctccatatccaactgtgcgtagtaatcgttcagcgttttcccggtatgctgtttgcagaattgttcaactattttaaggaggtgcgctcgttcctcctccatcaatggatagaaaaagtcgtgccggaccatcccattcttctggcggagggttaggtcaagtttattgctgatgccttggcgagcggcgtcataactgcaggtgatctccaaagaattttccggctttgagcagtccgtcatcaggttcagcacctctttctggaccccatagctgctgagatccagccggaacttcaactcccggtctgtgggaaaaggtccgtcaatacagagtatatctcccttctccaagggacgtaggcccccaatctcagcagaggcaaagctctccggctcgatttgttttccatccaagtggttgataaacttgtgccactggtattccagtggcacatgtaaactgcgcgtggcgtgataaacggcagctgagacatccttgatcttaaaagtatgccagccatccataatgagcaggctggagatccaagcggcgtccatatcgatttcaaatgcacctgaaaccttgccgatgttttccatacgcagggtggccagttcatcaaaccgctcccgcgtaatgggctgtgccttataaaagtggtgggagaaatcgcccttcaccgactcggcgcctccttgcagataacggcgcagccgtatggccacatccagaaattcctcgccgttagccgttgagaagatactgtcatggccattctcccgaatatgaaaagccgcatagactttctggtcttccgctgcctgtgctgactccagttcttcctttgtgatagctgtttcaatctgtacccaccgttctaatggaacagtttcgttgtacagcgttatcagatagtcctgtagatgccgtttaacatcactgccttgtgccttcagcgcctcctccagcgcagcccagcgccgctgatccagccacgcctcggtagatacagaatctgccattatttaacctccttcttctcgtcaagagtatccggcgcggcgcttcgaggggaccgggcaggccgcgggcggggctgttcctccggctccgtcatgctttcgatatactccctggtctgagaaggcacatattttttgtagagcttctccatgaacgtatccagttccaactctaaagaggtaccgttctttcccgcatataactggacggctttgagtttttcctgctcaaatgaaaccgtgactgtggcttttttcatcgtgatccctccattacagaaacagttccatggcatgttctgccctggaactgttggcaagtgtttcatcgtattgtgccagaagctgtgaattgacgccgtccagaaccagctccactccataggggccggggcggatggcggcaatcttggcatccagaagagccgagaattcttctttgccctgggcggtcagacggggaaggtccgctgcgggcacccagccaacatcttcggcggcatgaactaaatagacatcatgatccggcagtccaagtgtcaacagatcccgcagatggacggccggggcttccgccagcgcatggagctgctgctcctgcacaggctctggtggaaaatacactctgatttcactgccatccctgcagaaataatcgacctttctccactcgccgccatgggcaacctgcaactccccaagatggctgtatctccagttccgattattttccttgcaccactggactacatggtcgctgacgctgccggacttccagtcgaaggtgaagagagtttcacccttctgccggagcagttccgtccactgtacccggtctgtgaagcccatacttcgggcaacaaacgcctcacacatccggatcgcccagtcggacggctctgcctgatgttcatgtttctttctgaactcctccaactgccaaagcagatccaactgatcctgtttaatattgatgtttctttcctcctctttcgtgtcatcctttgactgtttatccagcgatagattgtttccaaaggcttccgtcaagctctcgtagatgctctccgtatcccattcgccaacggcagtcagccggccagcgatctcccgcaggatcgtttcctgggcaagcatctcatcgccggaaataagccagggccacatcttcgaggtttcctgctcaaagcgaatgtagtccacgatgtcctggtatgcgtcatcgcagtcaggctcatagcggtgggcgagatcgaaacccatggcctcaatctcctgattagtcagtcccaactcattgtgaagcgtcttgtagataccgtcagcgttggcctgatggtccgcggtgacctcgactccaatggcatggctgatccgctcataaatttcagccaggtcttcaataggaacggccaccatgtaggtttctgtggtctccacctcattgccttcttcgtcggtggtggtaaccgttcgggttcgctcctcataatccacgaaacagtccgcaaactcatggatgccatctgtatctggctgttctgcggcgaaatacagagcataaaaaatggccttgacgcgggtatcgtcaaggctttttccatcttcgcattgactattgatctccgcgatcacttcgtccagttggtcaaagctgttccgcatatcctcgatgtatctccggtactccggcgtggcgctggcggaaatggagccgccgtggaagcacagctccacggcggacacattgtgctgtgaggttcctgagaggatggcgcaaagcagaaccaccagaacgatcagcggggaaaggatagccacaatgccccagcccacctttttgcgggcttcctcattggaaagaattgctatcgccgctttgacggccgctgcaacggcggcactcataggctcatacctttcatggacgaatcctccggctgtgtactgttttgcagttcagaccagtacgcagccagcgcctccatggtttccgtgtacccatcgcctttgggccgatgctccgcccacagctggtactgctccagatcgatcccccgatccagcaggagcttggcggtgccgactgcctgattgctgacgcaggcatagagagcggcgtagttgtccggctccaccggcatcccgtgttccagcagcctctctgccatccactcctgatgttggcccgtgagggtgcgcaggatgccgaccacctcattgcccggccggatgcccttgtccaccagatccactgcggtctggaagtccagcttttcggcaacccagcggagaagcttcgggggcgcggaagcaatctgctccggcgtgcattgggcgatcaggtctttggcgatgttccggcagtcatttgtataggcatagaggatcacctcaccgtggagagatgggagcggctccgaaaagcggccttccgactccttcaccaatgtttgtacccgccagctgtctcccgtttccaccgcccgcttacaggcggcgagatatgcctccggggaaaaccgttccaccgccgcgagaagcatcagggtcatatttccacccacggttccggggcgtcccgccacctcgatcagcaggtcatccgtctggcctgataccctgggatagaggtttttgaaggcgtcaaattctccgtcccgaatggccagcacggttttatcgtagtcgctgatgtgcagggggtaccgtcccacctcatccatataggcggtgatgctcccggtcatccgccgcaggagctgttccgtctgggacatggcctgttcctggcgttcctgctgttccaccagcgccccgatgatggtgcgctgctccgcaggattcaggtggacgatcatgccctccggctccgcccgctcaccctgacggagatatcgggcataggtttcgtggtccccgtggaacgccttggtgatggcggaggagatgaggaacatccggtccagagccgcgccggtttcgtccagcgtctttccggtaatgaaactcctggtaaccggccggttgttttcataccacttcaggtacacatctaaatagacgccctcgctgccgccgtagtcggtggtacagaagatgtcggcgtctttggggatctcccggccattttcccattcccggtccatgagaaaatactcgttcggcaggtaccccataccctccaggcggtgctttaactcctcgaagacctcctgagcggtgcgctgtccggcatactgcgcccgtcggggatctcccggtaacggctcccactgttccaattcaatttttttcattcgaatcccctttctcttttatagatctgctgctggcagttcacctttcatacagcaggagcagggcagatcctcatctgagaaagcgcccggaatcgccagctgattttcatcggcacggataaaatcccgccaggcccagtccctgcccaagccccgcaccgctgtgaggtttggcctggctgcgtcttcaattgccaaagccctccgcaacagatccgggtagcggtggtagagggtgcggatctcccaccgtttcatcgaagggcagaagaagcaggatgatttcccaggcagagggagtccggcatcccggatcgcctggatgcattcctttcggctccagccccactccatcaggggatattccttctggtattttttatcctgaaggtcatgaggaagagctttggccagacggcgctcctctccggcgtcgtatccaatgaacttgacgatcttttctcctttcgcccaggcatcaatgcagggctggtagtgcctgcagaacttttcctgcggggcaaccttgtgcttgagggagcattttttgtacccataagcaatggagggcagcgttcctgagcggaggcactcctgctccagcgtcagcctctggccgttcttctcggtgtaccacacccgcgtgatcaccggcatcccgtggttctccagccagcggctcatagtgtccaggtaggcgtaggtatgcggctgctcggctccgggatcggcaaaaaggatcaggtcgactgggacattgtgtcgccacaatcctatcagcattgccgtgctgtccgttccgcctccatacccgaccacattcatcgcccgcccgctgtgccgaacagcgcctccttataggcaggagcgtgaacctccagcaggtaccgctcgttgccgcatttgaacaggcatacaccccgttgggggaatcggatgaggttgtactccgcctcctccagctggagcagatccatataaaaccgcttgtcaatggagccgcagttgaagatgaactggtggggcgggatagcgaacaggggcttggtcaactcccggatgccctcccggtcaaagtcctccagattctgcgaggccatgatgaggttggattccttcttgcggacccgcttgagtgtgttgcggatatactcgatgatggtggtacccaccgacacattatccgacagccacacatacagctcgtccagcgccgctgtggtgttgccgatggtcagcaggcggtcggacatataggacaggatgttgaacagcatggcgccgcgcacattcttgctggcctgcagcagccccttgaccccaaagacgataaagcgggaggaggtcacattggtgtacccgttgaagaactgagcctcggcgccctggcacatggagtggaggcccagcaggatctcctgcagcagttccgctgtgtagagctggtggcagttcccatcgtactctctgtactcctgctcaatgagttcatagaggtcggaaaggatgggatagtcctggggcttgaggccggcgaagttggtgctgtcgctgatgccccatttggcgtacagcttgcccaccatgatctcaatggcgtcgatgtggcggtctgagaaatccttgtaggcccggaaaaagtccttgagaaaggagatgtgctgggagagccgggtggatttgcggaatgcctccggcgcgtccctgtcctccaggccactgccgtcatcccagcacttgggctccagcggattgatgcggtacacgccgcccatcagatccatgaagcagccgcccaccgtctcacacatatccttttgttcgtgttccacatccagggagatcacggatttgcccgcctcgaggaagttgagcaggagcagtttgagcagatagctcttaccctggccggagttgccgaggatcaggatgttggcggaggtcttatcgtcatcccgcttatcaaaatctacgaggatattggccccgtacttgtccttgccgatgtagaatccgtgaggatcggtcttgccagaataattgaagggatacaggttggccaccgagctggccggaaggacccgttcaaattgggcaccgaaggcgttgcggccggccggcataacagaaacaaagccctcctgctgacggagcataagccggtccacattgagcttggagcggaccagttcggtcaacacatcggtctggagcagcttgagagcgtcatagtccggggcggtcagctccaggaacaccgcacagtggaggagcggctcccggttgcggtgcatggaggagaccagggtaaccacatcctgcaggttggcctcggcggtgacagtctgctggagatcctcggtgctggagcgggacattcggtgcttgttggcggcgttgtggatgatccggcgctcctcactgggggtgacctgccgggtgtagatgcggatggtgaccccgtccatctcgcccagatgccgcaggatggcctgctcatcggtagaagtggggtactcccgcagcgcccatacacagcggcaggtgttgccgcacaggtagtggtccaccttgaagtcgatgaccgagggggcgaccatgtcgaggaaatccttgatatacggttcctccaccacaggccggggagagttctttgttctgtttttcggcaatgaaaaaacctcctgtccaggccggcaggagatcttttatcgcactgtttcttcctgatatggcccggaagttctcctgacggccatatcaattaaattgtggggcacgggtcagtcattcagaatgatccagcgttccccgtcgtaatcctcatatttttccgtggtggcattctgctcaaaatacacgcccagcatgcgcttgagatcctcgccgctggcgaggcttgccttgaagccctgatcctcaaggcttttctggatgcgggagaggtgggtgtgcagctccatccctgtttcctcacgcaaccggaccagtacgaagaactcacgggcggtcgccatctggatctgcaggcggtccagtgatttagcgtccgcctccagcagccggctgatgaccggcaggtcctcctcggcagcccgctggcggtagtgcctcttgttgtcctcaaagctctccttggagttgagggccaacatctcgatctcagcctgccccttgaggacggtcatgagggcatagatgcgattgctcacagcctccgggggctggaccgagaggttggtgggcttgatggcaaagaaaatcagcctcccgtgactggtctttaggccgctgtcggtgatctcgtcgatcccgatgagctgccgggtagtctgtttggccgttgcttctttttttctgctcattttctatcactcctatccgttgatggattacacagcccccaggcataggtctgctggcccaggaggaaatatcggattgcatagcgcaggaagtccaagatactggtatcctccagccgaatcgagaggaaggcataggccgcagtgattaccactgggggcaggaagccaagttgggccatggcaaacacagagatcagggcgcccacgccaatgatagcgatgtcccgcagttcccacagccacaggacggctttggatttcaggttgtccgggtaaatatacaatacaatcacctccgcatgaaaaaggaaaaattagaagggaggccctgtttgggcctccctcgtctcgtcattctgctccgtcttcgctcagagagtcttcggtggtttcttccggttccgcgggtatatcagccgaggtgcctatatcttccactctctcgggggtatggggaaggttgtctgggctgtcatctggattcggctcttcctgtgcatccagttcccgcaggatcagccccgccacaaaccctttcttactgaggcccttatgtgcctcgagatactgttcgatgcgctggaacagttcggcggatatcccgtaagcgatggggcgacctttccctccgctgctcatgtccctgcggagttccgtgacctcacccgtgttccatctggccagttcatcttcaatcagccccagaacaaacgccttttgcgagagctttttgccgtctttccaatgggtattcagatattgttccagccgctggtgcagttcctcagagatctggcagcccagagtgcggttcccggtctgcccgtcgagtcgggcgaagtattccgtcagcaccctggtcagatattcaccgttggtgatgtcaggccccttatcctccagcacacgcctgtgcagtgattctgggatttgtccgcatagatttttcagattttccattgcgttgtgctcctttcctgatttgcaaggccaagtataccgaaagtcatggacaatagccattaccaagaccaacaacaattctcccggaaatgaagcacaagcaacaaccccttgttagctgttaaaatctatggatggttttcttctttccaccttaaaaaataagcgatcccgcgcaggacaaagttcacgcaggggatcgccacggagttacccagcgccttgtagcgggccgagtcggaagcgtctggcagttcagtccaatggtcaggaaagccttgaagccgttcacattccagtggggtcaggcggcggatgagccgtccagtccggactgggtggatagagttgagggaacttccggtggtaccctgttgaagtgtaccgcacagatcgccattctcccggccatttctgcagtctaaccctgccacatccatcaccagatctgtcgcatccttatgctggcgggcgctttgggtgctggccactgcatcttctcggaagacatccacccgctgcctgctgaatatagcgtgagaagactcttggcatggctcagacccttgtgcgattaacggcacattgttgccgccggtcccatacctggccgacatggtcggggcaacagtgtggggaccggtgtagcgtgcgtcaattccatggttctcatatagagcaggcatcatctcatctgatctcttatccacgatcagaggctggtgaccatgttcctgtgcccggagtgtcccggcaacatcttcgctgcaggccatgacgctgccgccctggtcattaaggcacaggatggagggaaccatgttggagccactctccgaagctttcaatgtgggggaacattctgtctgaaaaccaatcccaccagccgccgagccttgtccagcagaaaaaccggctgtaaaaatggcgggatacccctgtccaggcataccgccgcctccactcagcgaggtgtgacgctcctcagagagaaagcagtcaccgttgcctttagctgtgattccggccacgaaggtctgttgcttcatcccaggctgggcagccaacgctgcggccacatcatgcagatcccgcacctcgtcccgctggttggtagcaaaggcggtgatcacgccgttccgtccggtggacattccgcagttgacgccaagggtggctgccttttctcctgtcaggtctccgttgtatccgtcgaatccaatggggccagtcccgcctggaggatcagagcatcccggagctgaggcggcagttccttgcctctggcctccgctcgacgcagaatacccaggcaggcggttttgctcaaatagtatttgcggggcggatcgtcctgcaaaatctgcgacaaggaagattctcttgcgacgctgggcgacaccccagaattgagcatccatgactctccaagccaggctgaattgatctcccagaatgattgccccagcagattcccatgtcccggagtcaggtcgaggcactgaacaggagctgtctttaattcggacgatttcctcgaggacaatacggaaatcttcaccgcccgctgaactgaatgctcctggtacattctcccagcacatatatcgaggtcgaacagcgtgagctgttctgccgcgccgctcatctgcatccctcatttcttttacaacgcggatctgctccataaacaggccggaacgctctccggcaagaccggctctggcccccgccacgctgagatcctgacaagggctgcctcctgtgataatgtctaccgggggaagttcggcaccattcagtttcgtgatgtccccgacatggagcatggaggggaacctctttcttgtcacttcgatggggaaggcttcgatctcgctggcccacaccggctcgatgccgttgcggaccgccgcgagggggaaccctccgattccatcgaacaggctgcccagcgtgggcattatgccatacccatgctctgccctggagcttcgctttgctccatctcagcgggcagagcctcctgcttgatttccagctccccaatctgtcggatggggatgccgagccgttgggcctcctcaatctcacgggccatgccggaactgaccctgccgccgcagagccacagttcatcgcagacttccagcacccggtgtcccagccgcagtccaatttcccgttctgttggctcagcgtcatccaacatctgtgggtagagcaggtggacggcgatgggcgtatgcccctgatggatggcataccggcacgcctttttcgcaaacgcggtgtttgcctcaatatctcctgcatagggagaggcgatgtaaatcagtttttctctgctcatttcgccgcccccactgcctgtaccacggtgcgggtggtgttgaccgctgactgtgctgcatagacggcggacatgatgttggcgcgtgtcgaggtgtccagcccaaaggcgccgcagatgcggggcacttcaccggccgacagcatcaggccaaggcccagcagcgcatgatccttcagcaccagcagtcccgctgtaaggatggtggcctgcaggaaggtggtcagacacagaccgatgatctgcttgcaccactgcacaaaaccatccatatagccgcggggcaccgaaaacatatacagggaacccacagctatctggatgagtaagattcctccgcgcttgaggttggagaaaaagcacttgatgacggcgtaccccatcatgatgatagagagggcggtttccagttcagcggcgatgttctttttgtagtgatttgcggtcagacggataaaccaaaacggcacgaacatcatgcccaccgccagcaccggcaccaggaagaggttgcccagcgtcagggcgaaggtggcccctaccagaaaaagaagcagggacagggcgcacaccatgggaaacttggcggcccggccagtcatccgcagaatggtctgtgtctcctcgatttcccggcgcagaaaggatttctttttgcgccgtgtactctcattaacctccgaccggatgcttttgggcttactggtgattctgcggaacaccccttcagtgaagtccataggggagatgcgtaaaaggacaaaacaacctgtgatcagccctatacaggcaatcaactggatcagattcatacagattcgcctccttccttgccggtttcaggtttggcaggcggcttggactgtgcgctcctggtcttcggagcgggcgttgcctgtcctgcctttgccggactggagcctgacttacccttagagggagcggactttttgcccacgagttgggccagcacctcctgcggcataccattgtcgatgaaccgcttctgcaggctttccgagatggggttgaccgcctcgtggcggcccttaatacggtatttgccgtcctccaaccggttttcttcgattttgaagtgataaagggtgttgtaccggcgctccccagtgggcaggatctcacactccatgatctccatgattttacggctcttatcctccagctgcttggcgaacaccacgatggggaatgcctcggtgaccagatccatgagggtatcgtcggccatctcgtgcttacgcttgcagagggtgaccatacgccgccatgtagcctgggatgagttggaatgaatggtggtcaacacgccgtggccagtacgggcggcctcctgtgcggcatacgcctccgcagaccgcatctcgcccacacagatgatgtcggggtggtaccgcagggccatgtccagcagcatatcctgatcgatattctgcttggcgttctcgctctcacgggtgatggtgtggatgacgctgttgcacacccggccatctttctcccgcaccaggtccagctcacgggagccgttctcgatggtgaaaatacgcttgttgtccgggatggtggtcaggagccagcctgccaccgtagtcttgccggaaccggtggccccggcaacgcagacggaaacgccgtaacgcaggcaggcggccagaaagtccagcatggggcctgtggctgttccaccttttacgaagtcctctttctgcatattctgcgggttgacgatacggatggatgccgtgacgcccacatcctcgtccaccaaaggggtcttgaggaccgcgatgcggatgttcttgctgagatggcccaggacggcgggactggcattgtccagcaccataccgctgacatggagcatacggcggatcacattgacggcgtgttcagggctgtcgaaatgttcctccagcttgaccgtttcgccattggcgtacaacacctcgatatcccgccaagagttcacattaatctcctcaatgccggttccgaagatgtacttggtgagcaggccgaactcggccatctccgtgtagagggcgtccaccagttggtcgccggaatagcctttgaccgcgatgcgccggtcctgcacatatttggtgatgtaccgtttgatctgggccttggcgtcttcatcgccgccctcggtgatgagggcggaatacttgccggagatatattcctgcacatcctgcaggacggtgttgaaatcctgcccttcattctccggggtgaagaagagagaatgcgcccgatagccgcctgcagactctgtattcagggaccgcctggggagatcctccgccatattcacgctatctgtgggatcagcttcaacccctgtcccatcatcagctggggcgtgacgcagcggctcatccgcgggctggggttctccaacgccggcttcatgctgattctgacccatattgccgcttaccgggcagtccgggccgaaatagagggggagttctttcttccgcccgtccggacctgtcgtgatatgtgttgcggcggctttctcagcggacgctttgggagcgaacagggactgacttcgcttctcgcctaacacccaaacacctccctggcaatcttctcgatctccttgcggaatacccggctgtccttcatggataggtccgccagcaggttgccggccagatactgtccctccagctccgccgaatggggcagcgtgaaggccactgtccccagcgcctgactcatgtgatccccggcctgctggggctttacattgctggcggtcttgtactgcttgtccgtatcccatttggcatcccgcaggaggggaagttggctggacaggtagctgatgctcttgaggtcggcgttggccagccgcaggacggaatccgcctccatgagcgccacagcggagaggatgtcgttggcgatgtaactgccgcagtcaatgaccacatagggagcgatctcccgcaggcagtcgatgagctcccgcgcctgcacctcgttgtaaggcgggtaggtgtactcattctctcccttgagcatccccagcatggtgaggtaacccaggcgtttgtgggtgaccaggttgttcttgaccagattctccgacacatgggcggcggccaacacgctcccgagggaacgctcgcactccagatctgccgccgggcagatacagggaagcattggggctgtcatgtcgcagagaaggaggatcacattccggcgtttgtcggccagatacttggccagccgcacggccacggtggtcttgccgctgccggggctgccccacaccgccagcaccccgccgctctgatcctcctgctcacaggcgtcctcctggccacttcctcgggaaaaaatacccgctttcttgaagttcagcatcaggccacctcctcggttttcgcgggcgcctccgtttctgcggtttcgctggagtcagcggcgggttcggactctgcgggattctcctgtggtttctcctcggggtccggctccgggggatacaattccagaatgatctcgtcttgagaggtcaggaacttgtcggcattctcccggtcgccccggtagaccagcgccagatggatggtcccctcggcctccagctcggccaacactttggcctgctcgggggacaccagcagggtgacagtatcgggcagttccttgtcatcctcctcgtccacaggctcaccggtgttggcgtcatagccggaggaggcggtaacactgatgatctccacatactgcagctcagcggggacaacggtctggccctgctgcttgtagtccggggcgatcaccgacacaatgtcgccgctctgcagcttgccggagagcccctccgcaaaacttttgatggacacggagatggcctgctggctcccgtccaggctgtacaggtaggcgttttccgctgctggggcgtctgagagtttggaagggatgatatagtcgcccacagccagatccgcagtagcgtatttacccacggcgctctctttctgccgaaggacatcctctgggagattatagccgcccacctccacgatctgaaccatgctctcggtgatctcatcgccggcccggatgggctggactacccgcacgatctcagctttctggctgacgctctggttgaacagcggggtcagaccgaagcagatcagcagggagagcaggatgcagattacaccgaccacggtgcgatttttcaaaaaactcatactggcatttcctccttgatttcatgttgggtcggaaagtccgggcattacacccggaccgatctggcccttctgctccgcttcaaccggggcagaagaatggcggccgccgtcaggggcagggtcacgccaacgatggtgagcacagtctttctcgttacatggaacttcttcatagcagtcaacctccaaaacagtatagtgcggcaaagccgatggataaaaatggtcccagcggcagcgccgcccgtgtcattgcgggtagcggatgatgaatgaatttttgaaataacatagcggtgcagaaatacagcaccgccagcagcagacccagcgccatcccccagatcccccgccaaaagcccagcacaaagccggccgcagcagtgagtttgatgtcgccgccgcccatgcactccggccggatcagggcggcaatcagcaggggcagagccgccagcactccaaaaaactgggcggggctgaaggagatcagccccgccgcggcggtcaaaagacagaggaaatccgggatagtacgcttgcggcagtccaccgcagaggcagcggccagtgccgtgagaaacaggaacgcctgcaccgggtatcagcccttgtagtcaaacatttcctctacgcgctcggtcacggtgggcaggacggtgtccccgaacagagtgtagaggccagccaggagcagggcgcccagcaccacggcaatcaggatcttgatggcggtgtcgatgtagccctcgccgcgagtgttgcagagaggggcggacaggtgggcacgggcgcaggtcatggcgcagtgggccttgcaggtcatcgtctttacggtgttggacatcttgttgaacatcttcttcatagagagttcctcctcaaaattttagattgttgattgttgtgtggtcagtgggtcacatacccatcttctgagcctgctgtgccgtggggtccggcgcggactggggagagcggttcatcccctgcgtcagtgcctgctggtaggcggtcacgacagccgattccagttcggcgcgtgcctcccgtgtgtacggaaaacagatgtccttgatttcacccttgctgttgatctggccgggcatggatacaaacagcccattgctgccctccatgagcttgacgccccggacggcaaaacagccgttgatgttcagcgatgcggtggcccggcagggaccgtcaaactggatagagtggatacggacatcatactgcatgggaaggacaggagtatcctgctgggaaacctctccctgggggttttcacttgtggtctgcgcttttgccatggtgtgttcctccttttctgaatataaaaaataagtggcttttccgctcttgggtcacagggtcatggtcatgcctgattcctgctccggggctttcagttggacggggacgatagctgtgcggtccacatagtagaactcgctgccggaatcgtcgtagagttcgacaaggtctgagatggccagcggctgtccgtcgctgcccagggacctgcgacagaatgcctcccagatcccatccagactgttggtgctgacagtgccgtcaaacactgcctggtaacgggtaaggtcaggtccgccatattcaccactcatgcggtccagcccaatgaagcgcatggcggcgggagctgaggggccgagctgccagatacggcaggatttcagggctggcccgttgtctgctgccttctggtatccaccgctggagagacggtcatagatgccgtcctcccaccggacagccagccccttccttgccagccagtcctccaactcctcacggcggaacatggagtccgccaccactccttgttctgtcctgtagcccactggattcccatagtagagcagacatcgatttttcatttccacacttcgcatggcggcatatctcctttctgcggttaagtcatttccatccctcccatgcctgcattctgcccttgaagctcctccagcttttctctggcccagccggggaggaattcctctttcagaacgccggtgaagtctgtgcggttccatctggtctgctctccatcgcccaggcaggtacagcggatagaccgaccgacagcgtgggggctgcatccaaagccgtcatgggccagccagagctggttctggggcgtccagcaggactccttgagggtgtctggactgagcaccaacacccggccctcatagtccagagattcataggagttgggttcgcagtgctccggcccaaatagttccagcttgccgtatgcctccctcacttgactgataaatgcgtccagatacgccagggcggtgtccacttcaaaataacggttatgggcatcatcgggtgggacataggctttcttttgccattcttggttttccgcgctgagctgctccttgtaaggccccagcctttctatcgtgttggccaggacgaaattggtccgcttgaagccccaccgtttcagcaccatttgggatgcttccggctttaatgcgctgcggccgtcgccatagacgcggatgacggcttcgatgtcccgcgcacaggatgcattggcgtggaaacttgcatcccagagcgcagcttccccaagtctgtgggcctctgactgtgagccgggatagaggtagatatcctgttccatcttgcctcctttacggcaggcgccatttgcccgctggggggatcgtcagcgggctgatgcccagctcattgagcaggcagcaaagctccaccgaaagctcccgcagttcctccgttgaggggacgatgatgagcgctccatccgcggccagaaccgcgacttcttctcccacggggatagatgcctcggataacagtgcggcgggcagattgagttccataccgctgctggtgtatccggtacactcagcgtcgtcacaggttctggtcaccaggaggctgtttgcgtcacagtcgcagatgtactggttcgctggggtggtgatgggaacttcttcccccggctcatagcccattccgcgcatgaaaaatgcaggcagggtcagagacccgtctacaccgacccgaaccgttgtatggatcttactcatcgccgtgttcctcctgcccattgcatgcggtgcgttctccgtagatgagattccccaccatcagctgttcctccagctcgcccaggcagattccggcttcacccagcatctccagcaggtagggaggcacatcccgcaggtcatggtcatatccggcctcggcaatggtgacggtcttttcttcgtcatccacatagacacagagcttggccccggcagggatgccggcttcttcccgcaggtagtctggcagttccagcatgccgtcctccagatcatcgaatgggcagccatcctcgcagtcatcacaggtgccacagactctggccagatggacggtgagctccgtggccagccggtgcagggcatccatcgcctggatcagttccatggtggtcatttgctttttcagaacgaccaccgcgctgtccagcgtgtggatctcgaccttttctccgccctcaaagccactgatcttgaacgctccgccgggaatcaaaagagtaccattgtttatctgtttgttgaatttcatcttcttctccttattacattgaaattgtagaacgggctggattggatgctcccggccattcctgtccttgttgggcagccagcccgtcccggaaggctgtcagatcttctcctgtcggcgtatagcgtcttgcttcaagggcggccatcagcgcataggtctggccaacctcggacagcagtgcccgaagatcgtccgcaaccatatccgtccccatccggcggagctgcacggtaaaggtgattcggtaatgcggctggccggggatgctgtcgatccgcatatccattcccaagttggaatcgtgttgcgggcggatatagacctgacccactacgctggggcagacctgaaggcggccctgactcatttcctcaatcagctgagccgcctgctggagcttttccagttcagagagctgttcatccaattgcctcacccccgttccagtcaaacagcgtcatttgagagggaaccgcccggctccgctcccgcaggtcatagttggcgataagcagttccgggaactgagccccattgtcgtacctctgcttgatgttgttgatacgggtggtttccatgaggtagatgcctggcctgtcgtacagcccgcggacaaaggcgtcgtcgttgtaggagagcaggaatttgccctcgatccgcatcagggcgtcccgcaggcggatgtggtcggcttcggtgaaaccgtcttcaccaatgttctggtaatacccctcggtggcatggtagggcgggtcgagatagaaaaagctcactggccggtcatattgatggagcagtttttcaaagtccttgttctcaataaccaccttggcaagcctccggtgggcctgctcgatgagcgaaaagttgctacgcatatcgtggggctggctgccaaaactggtcagcccggaggcgtagctgtagcggatgagctgatagaaccatgccgcccgttggacatcgctggcggggctgtcccgcgccaaggcggagcggatgcggtcaaagtcctcccgtgcgttgagtacataccgcagagcctccatcagttcctccggtttgtcccgcacacagcggtacaggttgaccaacaggccgttgaagtcattgtagacctcaaagtcgttgccgggaggcttgtggaacagtacccagcccccgccgccgaacacctcaatgtaccgctcatagtagagggggaacagccggacgatcaactcccgcagggccttcttgcctccaatccaggacatgaaactgttcagggcgtatcacccccatccagcggcaggcgggtctgtgcggtatcctctcgctccagagtccgatccagtccccggatggcggccgcgattccgctgatccgcctggtcagatgggcgatggtggcccgcacctcctggtccgtggcggcatagaagtatccactcccgttgctggcgatggggacgccatcccgccgcagggcattgaccatgtgtcgaacctgaatccctttgatgccgaaggtcagttccaactcccggctggtggcggcgttgagagctcccatgtggtactgctccagatattccgccagccgttctttctccatgaatgcctcctttccgggcctgttttccgaaaaagggcataaaaaagaaggggccgttttcccctttcggaaaacggcccctgtgtcatattctatatcctgtttttacttcatcgaatcacccccagctcccgcagcggacagatgcggtttttgtgacttggcaatagatcggctatattgacagagcgggactgtggtgctcaggctggctatactcataccggcgctctccaccgttccaggctacatagccgtggtcggtggtcgagaggccatattgacccatattggcctctgcgtaggcagccccgtcaaaggcgtctgttatcagtctgctgggcgggatcacgccgtttcggaccgcaagttcccgcccgtatgcggccaagtccatgccgcgggggaagaactcatagtgctggagattctgggcgagatccagagccaaatccagccggtggcagtcctccagctccagcaccgcctgccatttgtccaaccagtggggtgccccctgaccctgttccgcccaaacataaccgaagtcaatggcatggcgaaccagttcgctggctgagtcgtactggtcgagaatacccgtcagatggggcaggcagcagtccacctccagtgcgatgcactcgctgaggctctctgcctgtagcgagtccagccccagcaggagttcgtccggatggtttgagtcgatatactcgccggaatccgggaagccaacccaaatcccctccatattgctccggctggccagtttaactcgtatggcatagtcaccggcgaccggctggagggtgggatcttcctctacgaagggatctgccagtttgatgttccgcacatagtgaccgttacaaaaggctccattctgcgactggtggtaggcggcccccaaatgctccgcattcaggaatggacgggcggcatccgaggaacactctatgctctccatgacaaattttccaagcgcggcctcgtctcccgcgccatagaagaggtcgtaacagtccagttgggacgcaatccgcatcacatggccgatctcttggggcttctccaactccatcgccccttggaacaggatcttttctttctctgtcatattggaaaagcgccgctccagccagtcatgctccgattttgtaacatagaagccgtccagcttgtcaaagagggcggcgttttgatctgacatcgctcacatcatctccagtccttgtcctatttcctgttccggctgaaataccgggagaggctggccgtcctttctgcggatcagaccatactctgtgataacccccagccggtcatccagcatcttctggccgatctgggccgcctgcggggtctggaacagctcctctggtaaagcagaatacttctcacggaacatcatctccgcatagccccaggtctgcgctacctcgggacggagttcgtactggtcaatctcgcccatcaaccgtgtggcgtcctgcagactggggtggtcaaccacggataaaagcgccttatacttgaccatatccgattcgggccactcccgttctatttgagccaaccgcttggcaaattcgtcggcctgttcaatgccatcctcatcgtcgatagcgttgttgatagcatctcgcaggaaggggatcaggcaatccacacagcggaatgcacattcatccactgaggcggcatctactttttccaccgctctccatataccggcatccgctgcgggaagattcagcactgcggttttgtcgttatcatagcttgggtcattgaaaaatcccttacgcacctccagcaccaccggagcatcggagcgatggaagcaagccgtttcattggactggcacacatagatgtccttgatttctccacccagttccgcatagccgaagtcggtgaacacgccgccatgatcctcctgatgctgttctcccagcagttccagcagtctttcccgaaagccgctgccctcctctgtggtgtcaagcagagccatagcctcatttgagagcatttcatttgcgtataaaaacgcccccagttcttcatgattggaaactcggggcgcaaaacagcagatatcggtattgtaggtcaggttaatcaattggttcagcggaatgggagcgacgcggtgattctgcttgattttcaaaagagcatccatcccttttttctgctcctctgtcagtgaggccaatcgctgggcaaacaggtttaggtcgtatagattagcattccacccaatcatggcatgcgtgaggccattgtaatggatgcaggttagctcatttttgcagaagctaccgtctttgattctcgccttttggagtgcgtcgctgaactccgcaaaggatgctggcattttcattaccgtggccgtctcataagatttaggtccactgttgctgatctccacctcgaaaattgtcttatccaagagtaatccctccctgtgtagactcttgctcaggagcctcgggcggttccatgtctgagtgaacttcgttcacggtttccaatatggattccaagtctcttttccgagaaatattcgcaaaatccacggagcggcagtatacttcgccatcctttcccacagagcactgtgtctgctctttgcctcgcatctttttcgatttcactgccaggcatccgtcatcggcaattcgtgaggagaagcccttttcctttaaccgctccgacaataccgaaaaaaactgccgcgttctcccatcaagatccattttatacgcctctttctataaactcattccctgcatctcaatatcttctgcaggagcggaaggggcctcatagagtgtgcttcggccataagcgatgcggatgatatcctctgcggagtagtcggagccagcgccaaaaagatgcctgaactgcaagcggtctgacggagcaatgtaccatgtggaatactgagacttcagccctttcagggattcagccgatgttttgaaggtcagttccactccgttcttctgtaccgtgacattgaccgtctttgcgccacttttttggagggcatctgtaatcgcccgcatccgatagaccggtgcatcgctgtcctggctgagcatctgatactctgccagcaacgcatccttctttagaaactgcgccagaaattcctcctggttgtcccgcatgtactgttccgcagttgtttttatataatcctccggggatttgaggtaggagagcagggtgtcttctgtcaaggatgtataatactcactgtgaaactgtacatcgggtttctccccagaaaaaacgagggaagctgcctcccgccctgcctcggttcccttgtaataccggtatgaattgatgttcctctcactggtgagttccctgacagagaggcgacttcgctcattggaaatggccgcctcaacatagcggtcgacctcctgagcgatgcgcttcccaaacgccgtagaatcctggcattcttcttccgtcagtccggagacaaagttgggaagggggtcatccagaagatggagcgcctggtgttgccggtcgtacaggccgcagaactccaaacggtcgctccagctgatcctctctccataaaatgtttcgcatccaaagaggtaatcaatctctggcgttgcgggaactttcactactgagcccaaatgcttgcccttttgcagaactaaaactggcacagcggcattttccagccactcttgaaactcctgccggggaagtggggcctgcttttgctgcgacattacaaaatcctcccattttactgtttctgctcaaagtttgcacaacttgtctgtcccgagtatgactcttcatagtgtttggggtcagcaccaggcacatcccacccagccatgcttcctatctccatagcttgccgctggatgggggtgacgcccaggtcttcgttcaactcatccgccagttccacattcccttccttgtcgccggtatcccagtcggaggggtagtagccagtttcaccccgtttgatgcagataagctgtccggtggtccgcagggtggagaagcacagttccggcaacccctcggccaccttgggggcaaaccgttcctgttcggtttggatgctccaatcatcaggctgccacagatggacatacagctcgccgccgtccacctcgatggggcgctgctcgaagccttcgccccatccgtcagaggcttgtccacccaggtactcttttaagatggtaagctcttccggagtcagctctccggccacccggcactccgctacgccccagagctggcgattcctgacctcaacagtaaacaccgccgagcggaccttgtgatctacactgtcgtcctcaccgtaccagtgcatgaggccgctctcgttttcctctggtacccggttttttaccagagcggacagaatttgtccctcataatccatgagggtgcggccatcccactcctcaccgtcctctgacatatccccccactcgtcccgtccatagaagtccgctgtgagcggcatatacaatttgaatgtctgaggctctggcagatagaccgagaatcggtcttctcccagcaccagagccaaggtacatccattgtcccactttacatggaattgcccggcatcgtcgatataatccagtttcccggtactgccgggggaaatgggccggggattaccgcctatctctgtgagttggatgcgggaatccttggggaactgctgccgcaagaagtccagccactctctcggtacgctttgcatttacatctctcccattctaatcccaatatccggctgatttaattgttgatagagccgttccatcgcctccgccaccacgaggtccgaccggaagctttccagtttttcgtgatccgtaaagaattgctgttcaccgctctggaaatgaacaaagtccactgtggcgataccgtccttaataacgcccagccgtttctcactggtattgctgtcctggtagatttggattgcttcctccagagtcagatcttgcctgattatctcctgcggggtattggtgtccgtcatgacaaaccaggcataggtgtggggaatgctgggatctgcggctttcctaagagcctgcttcccagtttcggtcagtccatagttgcagggacggcgtgaattgtcctcaccggcaaaatccaacaggatatcgtctaccgcttttttgacctccggatcgtctgtcagcgtttcaaagcggaagccggttgtgctgcggaagggcagttcctcccggatggcctggagcaacgccttggaatccgtgaactcctgctgttcgccgctggcgaaggttacccgacctaccacagggtgttcctgtcggtacatctcctgctggcaaagatcatagcaatagaggtacccctgatactcgccgggaaagggagtacagcgtagacagaaacggtaattttctgtttccgcaatatagccataactcctgcggtcctctgtgatggagccgccatgctgccagcagtaggcgtccatggcccccagattcttcaggagtccagtctgacgcaggtcgtccacaaatcgctgcagcacctctttgaactccggggtgttgaacctatcctcgttatggggccaccaggtgtgccagaactccttctcaccatggccgaaatccatgcggaggtggcctacagtacccagtgcctcgtccagcttttcttcggaatagaacagccccacctcatccagggaggcggggcgcagtacaaactcacgattatcctgggggtaggccagatcatgctcctcgcaaaactgctccagcgtcatttcttctcccagcagataaaatgtgccgttgacccggcgcgaagcagtaccttcatgctttaaagggattggagaaagtacggttcctgcatgatagtcagcggcatgatccaccagagtggttcgggtgctgggagatttatgtgtcccccgcaggtcatagcagtaccacccatcaggaatgatatcccgctgaatcagccagttggtgaacagcacaggttttccaagcaacgctgcgtgttgcatggagtctgtccagatgttaatgctcatttaatccctcccatattcacagtgttttcccactcgtgctggttccacagcgtatcttgtatctgcgtacagggattaatgcatctgcaacccatcttgtacttcagggaacggatcactgagctttcggagcaggccaaattcggtccttctcacaccatcctcccgcatataaaagttgcccattgcttcgaaatccgtaaagccatcgagggtagagatcagctcctcgtccgccccgatccgctccaacacctgcttgccatattcctccggatcgtccggtacacgctcgtagtcatccagttcgatggaaaacctcaaagcctcctggagcgttgccggctgttccacctcaaggacagagaggtatttcagcaatgcgccatcctcctgatccattatccggatattttccgccaactcgtccaattgctccagtctcagatccatcccctggagaggaagatattcccccagataaggccgcagggcctccacccgagtgagtttcgccatattgaggctgtccactcccagaagttgtctggcgctctccaattgctcaaaggtcgcaggcagagtgatctgcgctgtttcgctctgtacacgaacagggcaggggttttccatccatatccggaaaacgccgtccaatctctcgttctccaaaagttcaggtgtctttttctgcacataattgccgctggaatattctcctccatgcttttcccggtattcagcccccacacgggcataattgatatagggcttgaagcgatccggaaatggtgtgatccctttgttcacaaggtagatgcccaattctgaatcagacgacacattgttgacgagcatatactcatccagcctgtccgccacagtaagggccccctccaagttccagacacactccgcatccaatgccccggaaaagatggcggctttcgccggagaaagtgcctctgtgcgttccgccagtttttgtagtttttgaaactgctccgaatcttctacatccacatcgtacaggcatcggtaaaggaccggtacattgctgctcacatccaggatggcggtggctgtggtatcgaggctgattctgtccaggaaggcaaatgtctccccaatctcagcgggactggcgggcagttgcagacggacagtttcttctccttttccccggctcagagtcaacagaatcatcgttacattcctcccatctgaaattcctgttcccgctggtgctgctctgccggaccgccggccatcagctcccccaatgtcaatgtgccacagtaggccacatatcctttctccgtgaaggctcctgtttccttctccatacggagtttgccgtaacgctcataatcatagaactcctccagattggggtcatattcataatggccggagtcctggatcatgtatctgccatattcggcgggagtgcggactttgggtgcaaactcaaacagctccagatttttggccagttcgcgtatctcgccggcacactccggcttggccatctccatgaccgccgtcaactttttctgttccaaatcagacagtgcagcgatggccgtcgccatatcattcagcgcgaatagatcctcccgttgtccctccaggacctcctccacctcggatggaagcagactgtcctcataccagatgcgggcatcgtggatgttaacgcctgagcgtgcaattccacgctggagctgttgctcggagcagggcaggagcagccaagtgatttgatctgtattttccggctcctgccgggaggaaagccctaccgccagcagattcggctggtagtggtaacaggggaagtggcggccgtcatagagctgctccagtttcatcccgttatcatagaccacgccataaggggtaatccttccctcaagatgattgaggatcaggtccagagcgaacttgcggccatccagccgctcgagctcctcgattctgcagcccccaccctgcatcgtcatgtagtgctgccgcccaatggcgtccaggtcggagaagtctgtgatgaccgtggcctgctggcagcaaaaggtcagattgatgaaatcctttatatttgagacgcccaatttgcaggccattccctggaactgggcagcctcaccgtcatcaaaactgtccagccgtttggccagatagtccagctcatcaaaattgaccaatgagccaaccagcctgttcagtacggtatagaagctgtccagttcatccacccggcaatcctgccggagcgcgtcaccgatttccaatggctccagcagttcgatcatgcggtcatatttctcatcggggatagggaatggaaccgtaatctgcccatattccgggtgctgagcgctgctcagtaccgctttcagcacatagcccattctggtgcctccttactcgcatccatgaccgcctttccatatctggcaatcatggttgcgtaaataatattgtggaagtccagatcactcaccagttttgggtgtgccaaatcttctgcctccatgggtgacttcaggtcatacagccgtctggcggaataaaagatggggtaatcctgtatcgcaaatccatggggtttggatacgatgcggctgaaatcaatggaatcgtgtgaaagagcggggagcgccggttgccagagtcgctcctttgaggcgagaagatagagcgccgccagatagccaggaggcgcatcatcccataccctgtccgcaaagcggcttctgaggtggacggacactgtgtgcaggactgcctgatccggcccgctccagtgttccacagcctgaatcctcttgtgcaggccggcatgagggatgtgtccgaaatattccagaatcaaatccaggtactcaatcgcgccggacttcaaccgctccgcgatatacggacaggtgcggacttgacaggatcggcggcggtaatgcaggcagtaccggcaatccacatcctccggcttgtagcagaagcggctgaggatcatcatcccgccgccgcgcttctggaagccagggacgctcatcatcatatgctccagaccagctcgaggggtattctgagcgaaatatcttgtcatggcacactccttctttcaaaacaaaaaagcgggagctgcttatgctgcacagtgtgtgcagatgcggctcccgctttttctgatgtcacatatcaatttgtggctcctgtgcttgtccctgctccagtctgtccgccagatctgggacagtgtattcgatctttgtccttgcggtctgcatggctttgaggtgtccatcttccagctctgggccttcatccagcaggtagtctgtggcccggtagagttcagttagctcctccggtgagaaaagctgggtcttggagatcagcccggagcggacggcaaaatcctgcttggccccgcaaaaatcttcatcataataatgtccgtagctcacgccggttctgttatagtcccagatccaagtgacaaactgatagcccctgccattttccaacttccggccagccagcactgcgccgccaaaatccgccagcagatggaatttttcgctcagaccgctgatatgaagggtgggcgcagtttgaacctcctcaacataagtgtacacttcatctgcggtctgtgcgactctgtggtacaattcactggcctccggattattgcttccggcaggaaaaaggaacacatcgtttcctggagaaacaaagaggacaggctgaccatggaggaaaatctccagccgcctatcctctacattggatgattcaactccgccttctctcaggcgccgggaaagttcttcaaaaaattttttcaatggttaaacctcatttcttttttatctgttgggacgacaacaaaaaagcggagattctatcatcgaatctccgcttcaataactatattggtttttctccgggggaagggaatcaggtgtccgtcctctttgtgttttcgtatggatagaacaatgactcacacatttggtctgtgtgagtcattgtttttggtggagataagcgggatcgaaccgctgacctcttgaatgccattcaagcgctctcccagctgagctatacccccatgttgccagaaacccttgattttgctggatttctgagctattcaattttttgactttactctccgttgcgggggagcacacccggttgcttgcgctcccagctgagctatacccccatgttgccagaaacccttgattttgctggatttctgagctattcaattttttgactttactctccgttgcgggggagcacacccggttgcttgcgctcccagctgagctatacccccatgttgccagaaacccttgattttgctggatttctgaactattcaattttttgactttgctctccgttgcgggggagcacacccggttgcttacgctcccagctgagctatacccccatgttcaatttttgctgttttgctgaccgaacaaattgtattttagcagagtattacccatttgtcaactacttttttcgcttttttacaaattcatttaggtaagctgtgtggacggcgtgtaaaagtgagagcatcacgcaaattgaatacttcgtactatgtttgcaattaataatagcatctatctttttgacgcacgcaacctgaaccgcccccctcttttgaacaagtctaaaatatgtgccctgcatctcccaagggctaaaaattggaacggcactcttagagactccagcaaaacgatatttatttttgattatgcctgcttataatagtccactatagcgctcaactcccaaattacaaagaactctcgctcttctcgctctattggcaaaaaaacaaaaaagtagttgacaaatgggtaatactctgctaaaatacaattcgttcggtcagcaaaacagcaaaaattgaacataggggtatagctcagctgggagcctggtacaagcgtgtactagcacccctcaccaaaattgaaaatcgaaatcttgtgcctctcccatatatgggggtatagctcagctgggagagcgcttgaatggcattcaagaggtcagcggttcgatcccgcttatctccaccaatcaaacagggaaagtgcgcaggtatttcggttcggaaaagtggcagaaacgtaaggtttctgtcactttttcgttgttttagtcatttgccttcattttgtaacctccaagagttctaacgtgctttctaacacttttcaagccagtttcgagagagttgcggtgatcttttcggccatgcccatcttcctgcctacgtcaaggtgtccgtaaatatttgcggtcatcttgatgtcggaatgtcccagccactcctggacatcctttagcgtgaaacccgtattgagcaggaagctggcacacgaatgacggagttcgtgaaatcgaatgtggggcatttcgtaaatctcaagcagccggctaaaacgatggctcacatagtccggagcaaatggccgcccgtcatcccatttcaggatgtagttgttttctgtatattgggagcagaataggcggcggttttcgtcttcctgacgcttcaaatccaaaagcatctctcttacatccggcgtaagcggaaacgttctgcggctggtcttgtttttcgttttgtctttctccacaatctgtgtgaccttggctacagtgtgctttaccgtgatcgtgccggcatcgaaatctacgctgtcccacttcaggcccaggacctcactgcggcgcaacccataaactgcggtgagcttgataactgggaaaagattttcgtccctgaccgcatccagaagctccgccaactgcgccccgctgtaaaagtgggactcatagtgttccgtctgcggcaaaatgagaaagtcacagggattattgggaatcatcccatctctcaccgccatgttcagcgtctggtacaggatgttcttgtggagccgcagggagcgcggagaaagcccgcctttcccatctttgcgaccgttctggtgcttctgatccacgtacgtttgcaaaacgcttcgatcaatctcggacagcttcagcccaagctcctcgaagtatgggaggatatgcgcgttggataaattgtaatatccctgcagggtgatttcatccaccctgcctgcacactccttcagccagagccttacggcatctggaaagaacatatcggagcatttgaactgttccttgatctcatattcccgaagcgtctcgcggagcatctgctccgcttttttcttgttacccttgacggtgtagccggtggaaatccacttttggcggcgctttccgttctgagtgagattcaacaccatatagaatttgtctttcttgatttgcaggctgcctgtcataatagactcctttcttagacagtcagaattgcccgccattacacgcccttattgtaccgtgtttgctgaatgtagtcaacaaggtaaagcttcggaatcagaatcctgcggccgatcctcttgctgttgatcgttccgtcatttactatctcgtaagctttgttgattccgatgccgagggcggcggccaactgcttgactgtcatcacatcaggataggatcggaacatcatctcttcccctcctttgctggcggagccatataaaaagtgcagcggcgtattgtccggtattgatagcgctgtgcgggtaagtcgaagaatccggagatacagcgccaatggctgatatgatgcaaatgccgtccgttgcagcgggtggtgccgatattgctgcccatttgtaattttcacctcttctttgtatctcatatggtgagtggatcagactgagcgtttcagactattccgcgctcatagttataaagccgggacaggaccaattcaattccccggcggggcatggggtgtccatccggacttcggagtgtgtaccgctcctgcggatgatattgctcttccaattcgcaaagaagtgcaacggccgcagaatagctagtacgcggcagaacatccagaccgcacaagcaggtgcagggctctttctgagaagaacggcacgctggggtatgattttccatgctgcccagtccaggcagtgctcccacggtgtccatgtctttcaaagcggatacctcccatctctgaatatgccggaaaaataaaagatatggacaggctggatctgcctgtccatatcttttcgatggtactattgtaacagaaaaagtttttacttgcaatcccagcaagcatgagtttttttcgtcactccgagtgaagaaacctttttacttttcgtgaaattatgctggcgacacagcatcgggccagcttttttgaagaatgggggcattttgcagaaaaatatctatggagaaaaccgcaactgtccaatgagctcctgatgtgatatgctctacctgtatttaggccagatttcgccaggtcggagattactcccatgggccccttggggcctgtggagacttgtccacatcctaaatacctaacatcgacacaaaaaccgcagttacctactttataggggactgcggctttttttgtgcaaaaaacgaaaggagctcttagttatgaatgaaaacctgtttagcttctctgccatctctggtcaaggggagcaacccaaattcgattctacggcatttgaccttggaagcgatgtgaatgcccctccaccccctgctgctgttgtgcctcctgccgctccggccccttctgccgctgcgcctgtggcaaacgctccagccttcgccgctgctgcgcccgtggtgactgctccggctcctgccgctgccgcgcctgtggtgactgctcaggtccccgttgctgcgcccatggcgaccgctccggcccccaccgccgctgcgcctgtggcgactgctccggcccccgctgctgccgcgcccatggcgaccgctccggcccccaccgccgccgcgcctgtggcgactgctccggcccccgccgctgccgcgcccgtggtgactgctacggcccccgccgcatctgcgcctgtggtgaccgctccggcccccgccgccacaaccgcagatgcggccaacaatgtggtcccgtttgcccctcccgcacaggagagtaatgagggtgaaaaccccctgctggcaatgatggaccttcaggaaacaaagaacgttcaggccgccaacgcctcgctcttcgcgcagcttccccagttctcctacaacgggactacggaggtcattgagaatttggatcagacctttgaggagctgcgggaagccaaagcagaggactttaccgagcttgaggaagctgcaagcgtcacctggaatgtcacttacggcactgttacgaaaaaggtggcaaagcccaagaaaaccaaaatcggagaattcaaacgcgaaatcgaaacctcgaaagaatttctggatgggctgaaaaaatccacgacaaaaaagccggcctgcattgtcaagccgtctgtcaccatgaagccaaaagggattgccctctacaagggggtgtttcttacaatggaggaggccgaggactccgggaaaaccattacgttcatcccttctgctgatggactggtctatgagcgtcgggtgacggaagctggtgaatttgtgacgcctgcctcggaggtgaaactgttggacaaaattatccccggctttgtaccggcccttccacgcattccgtatactctcttttcacaggcgctggatctgttccgctatatgatgaaggccagagcagacggcacccctttggaggcgctgatccatatttactgggataaggaagatgaaaagttcatcctccatgtcccccgccagtctgtgggtcatgcgattgtccttcctgatgcgggggaggagccgctggacagcgaccgatatatccactatgcggatctccattcgcacaatgacatggatgcccgtttttccgccgtggatgaccgggatgaacgtgccaaccggatttacatggtcgtcggccacctggagaactatttccccgagctgacggttaggatctgcaatgggggcacacactggctcatccccgctgatacggtccttgagccgcttccaacccaggtatttcctcacaagtggctggagcgtattcagatgatggatgacgcagcgcgccttgacagtgagtgttttgacatggatgaagtctgggggaaggccgcatgattttctcaaaatcccgcccggtcaaaatcgttttggtagggaccggcggcaccggaggatacattgtacctcagctttaccgcctgctttacgcattggaccggccgatccgggtcatcctctgcgacggcgacctggttgaggagaaaaacctcgggcgccagaactttattgaagcggatctgggaaaaaacaaggcaatggtcctggcagaacggtattccaacgccttcggaatcgaaacaagctatatcccacagtatgtcgaggatgaggagatgctggaagaactgctggagcctttgcagtatccgcagaacaggtatgttaccaatcagaatggcgaagctgtacggaaagtcatatcggaaatcgtgatcctgattggggcggtggacaataaccgctcccggcaggtctttcacagcgttttccaacgcgcaaaggaactgatctatattgattccgggaacagcaaagcaagtggtcaggtgatctgcggtgtccggcgaagcggaaagaccttctatcagccggttgccagcctgtatcccgaggtcctggagcaaacggataagtttccgactgaactctcctgcgcggaggcgtcgatctccgcgccgcagactattgcagcgaatctggcggcggcaaccgtcgtgacgatccacatctacaatattctggcggaagggaataaccattccgtcgggaaaagcgttttctccaccaaatcggtcaacatccaatccttcaagaaaaatgtgaaacggagaaaagccgcatgagggcagtcagtgtattccccctggatgagtttcgtctcgcactgaagaaagtatatggagcggcagcgcccaaagggccatttaccgcattatcccaggcaactttatttttcagccgtaactcctgtaccattgcctgctgcaatctcaaccaatggtgtcaggcgacgatcccggcacagggcgatgaattttccctcaccctatatgatacgcaaagacttctggatgcctgcgcttatttttctggtgagcttcatctggaatatgaaactgccgagaaaaagccgcacaactgtgacatcccctacaaccaggcgcgtttttcctgtggagggcgtgagatccatcagttggtattcgacagcgatctctatccgctgccgaaagagtttcagccggagcaggtctatcagatcaacgctggaactgttttcggcctcttcacacaggtccggcacgctgtttcctcggacacaaaccgcccctggagctgctgcgtacaatttacggatcacaggatgtacgcgctggacggatataggctgagcgtccgagcgattccggactttgaagcagccaagccgtttcaaatcccggaggaagcgatggaactgctgagtgtttttgccgatgaggactgcaccctgtcgattggcagggagtggctgtccgttcagaatgattccaagcggctgattacccgggtaccgccattgggcagtttgaaactggactccaccattccgaccatcttcacagaggagcgctggatagatgtggaaggtacacgaaacgatctgaagtatcttctgaaaatggaaaacaaaaaattacgagcgccgctccgccttggtgacggctggctttccgtccgtggaaattccggactgtaccgtgcggaattgaggatggagcgccctcccgccattgtgatcggctacgaccctcgctatctgctggatgcctttgacgcatttgcaaagcgtggcatcaaaacagccaggatgagctttacaagtccggtagggcccaccgtgcttacggctgacaacggctttaccgaactgattctcccggtgcgtctgaagcccgaggaagcgaccacctatattcccccgcggaaacaggtggcataacacaaaacaaaaaactggaggttgcacatcatgaaaaccttgtatgttcccaaaggaaaaacgctgcattatgagcgccttgagtgccagacgattatcgcggacggcacactggtggttgacggcgctgtgagagcgaagcgcatcaccggaaaaggactgctggatgcaggctccgtttattctcccgcagtctctgttcgggatcttgacacagtgaaggttgtttgtgatctgctggctgcggagtatgtccaggcggtcgaggtcatcgtctcaagctccgctgtggtgtcccgctatttggaggccgagtatgtggaggccaggaagctcaccgtcagcaagcaccagatcagcgagctgcgtgtggaggagtttacctatctgccggaaaaaaagcggggtgtaatcggcgccctgctgtctggcttcttccgcagattatggctgtctgtgaggcaccgcaccccgatcaacgcgccctacaagcagtcatccccaaatgcgaaagaggaaagcggcatgaagggggctggtaccaccgctccggtcaatcccacagaagcgggcaaggccggagaagccatccagcaggatcaggagctgatgaaagcgtttctggccagagcgggaaagggtgaagaccggctggcagacgatttcgacttccttaagcttaaagcgatgtatgtactcttaaaggatgtcggctataccatccgtctgaagcccatgactgatccgccgtccccggcgtaccagcgcggagacgggcaggaggcgggctcaaaaatcgaacctgtgcctgttacggaatccgcagagcgcagcaatgcggcgtaaggctatgagggtacccgttagctatcggagaacggaaagtgtctccataggcggaaaagtcctcgttcaagatcggtatgcctccggctatctggacgccagtggaacattccgcctcacatcctactgcatgtgcaggcgtttggctcctttggcggccccggacgtcagccaggcaaaccgcaccgaaaagcatatgataactgacgccgcataggcgtccccaggcagagggccgtgacaactggttgcggccctctcctgtgtatcatgtgtaaagcaatatccaggagatgggcatccgccggccggactatggaagatggcggttatgcctgtgatcttcctgccgcatgtctatcatcaatccatgaaaaggacgaagccatcatgttaaactacgtagaatatccgtccagcgtcaaggaaggtacagaaacaccaggagctttcgaccagaacgggcagcgattctatgtgctggaccggctccaggagcaagtttccagaatccgctatctgctcgataccaccgtattcttccgcaatcagctggagacatgccaagctgccggcaacgctgaagccgcccaaagcgcttacctgtcgctctcgtcaggccggatcgggatcgccaacggcgtgaggtctctgaaaccccttctgctggagcttgagcatcccgccgcttccatctgtgaggcgctggtcaatcagatctcatcgtttgagctgatgacaagagattactccaagttctccggcgggatcagccgctttcttgacgcgctgcccagttaccataccgttgacgcgtctaccatcggtcgcctgatgaatcatgtcaagttagggcattatcccaccgatttgacgcatgtagggtatctggagcggggcatcgtttttccggataagacggtcaatctgctggacccatgctgcggaactggggacgcggtgctgcgcctggccctcggacatgacagccggtgctacggcatcgagctggatgaggaaagggccggactggccgagcaaaagctgttccgggttgcctatggtgactttttcagctcctatgtgggaaacagatcatttcatgcaatactccttaacccgccatatctcacagtcacacttggctgcgggctgaggggacgggacgaaaagcgattcctggtcgaagcatttcaggcgctggtcatgggcggcctgatgatctacattgtcccctactatcgaatgacagaagatgtctgccaaatcttcacagataatttttcggatatatctgtttatcgctttctggacggcgaatttggaaaattcaaacaaatcgccgtccttgggacccgaaagccgcgggaaagcgatgaagctgccagcgccagcctctacacggccgcgctgcatcctgaatcgctgcggacactggatcagcttccggaagggcgctatcagcttccagatgcggcattggacgtgaaaatttttcgaggctctgtatttaatgaatcggagctggcgcatcagcttatggcctcccaaagcctggagcgtctgctccaaaaggacgggcaggaacaggagatgggacggcctccgctccccttatccatcggacaggtgggactgattgggggctccggcctgatcaacggcctgatgcagtgtgactgccctcatattataaaggggcggatcatcaaagaacgccatgagcggagagaagaaaatcactctgaacgcggtgaactgatttctacagatgtgattgaaaccatcaccaatcgcatggtgttcaacatcctcacgcccacgggatttcgatccttggtataacaattcaggagggttgaatatgcaagacaaaaagtatctggcaaccattgtgccgctgggtccgcaggcccggaagcagattcaaaagggtgaaaacctggatgtgatccgggctgcggtctggtccgaaacggcaaaaaaactcacgccgctgctcgggtctgtgtgcagccggtttctgccggccacatacgcctggtcaatttgcaattaccgtccctttggcgtcatgcttggcggagtcacagctgatatggaggatatgcttttgtgctacacaagggcacggctggaacagatgaacgagatagaggcacggcagcagcgcctgatcgctcagggggagaccctgttgaacgaatctcccatccagtccctgaatatcacagtggtttccattgacagcagcgatccgggaactcggaaggaactggagctggcgcaaaagtttttcagcggggatgtctccgctgccgccgggatctactatctgggctataactgcaaccagatttctgaatctcaggaggaacaactccttgaaaatctgcaggaatacgccttgtgtgtggcggagctgcaggagctggaggtggcctgatggcacttttcctggatttggagagcttggccagcctgctggacgaggagccggaaaccgatgtggaagcggaggaacaggagccggtcaactcttatctgctccatgaggttttgccgcttctggaactgggcctttatccgcgcttagcagacatcgactacgatgaattcgagtgctatgacccggcggcactgctgggatacatagaggaatcggggcgacggatgtggaatcatggagaactcatacgcagcatccggaaaatcccccctacatgccgcgccgcatttgtgtgacggcagccatataaacgaactgttttatgaggtgatcatgtgcttgagcttgacgaatatgagatggacggcatcgcaaaattactccatatcgcaaagcgctttgcggaccgcgggcggctcgaccttctgctccaagccagcggaaaggacgccattttgtccgttgagacttatttggagctcgaatatgaccttccctgcctgattttcgaggatgtgacagtgcagcgccatccggaggacgactggcgcatgttttcagaacggaccgtctatattatgcgggacagccttctctcccgttttgaccagctctgccgggaatacgaggcggtccgggggattctccccattgagaatccattcgcgtccaccttagaagatgctgtcggccgcttcctgagaatgaacagctattcttatgactactgcctgtacgacagcctgcgggataaaaaggggccaaagctcgtcctgatagtcgatgatgagtttgaagcatactacgacattccggacgcgctgttcggcatactggatgcatgtgaggacgggattgaccatctggagactgaactggcccgcctgaaacgcgaagcggaggaaaataagcggaaggtcatcgcctttcccaaaaagaaaaacgcccgcaggagaaaggaggcagcttgatggaagaccgcgtatccatccacttttctgtggaggatgggatcatcgaagtggaacagaaaaaggggcctctgatctcccggaaggaaatttcgcgggaccagcttctaaattgcttccggaaaagcgtctatatcagggaagacgcaccgcccgtcctgtcttccgggtttctgccattgaataccctcgctgtcaggcagactaaggagtccgtcagcgtggtcgtatggtacccccgtctccgtgcggatctgtcgctgtataaaacgccttatccggatttcccgatcccccgccttgtcttcggtttttcagtcggggccgcagacggcgctgtgagcgcatgccggatcggagtgatcgcggatgaaacaccgacaccggataccattatgtatcgttatccattcagcaatgttgattcatccggcagcctgtgtatcgggaccaacacgctcccccaatataaggaactgcgaaaagcagccggacttcccgcattgctgctcagcattcccaataactttgaccggtttgatccgtccgacaaccaactggggcttgagtatcgggatctgatgcagcacttgaaggacaaggagcctgcatattactataccgatattttgatccccaatggacagaagcttgcccattttattcagcgcatgtgacggcgccggcaaccgacttcaatggaggcgatgtgaatgtggcaaaaaacgccggaagaattgcgcgctgtactcagcgccccattttccagttccgacattgagtggcgggtttccgccaccaatgcggaaaaaaccaagggactggccgtgccctacgttaccaatcgcgccatccaaaaccgtttggatgataccgttgggattgacggctggtacaacgatttccgtccctggaaaaatggctcagcccagttgtgcggaatttctatctttttcccacagcttgaacaatgcctgaccaaatgggacggggccgatgacagcgagtttgaatcggtcaaaggcggactttctgattctatgaaacgggccgcagtcgagtggtcgattgggcgctacctctatggtatgactcaggtatgggtcacggtccagatcaccaacagcgggaagaagtctaacgcccggattcgtgacgaggaacgcccccggctggatcaggcccacgatgaatgggtggcatacctgcaggccaaagaacggggagaaaacccgccgaggccgaaagctcccccaccgttaaaagctcagaagggccagaacgggccgcctgcacagacccagggccagtatcaggcgcctccgcagggcgctcagcagcgccagcggcaggaccagggcagaccgcccgcgcagcccacgggccagtaccaggcgcccccgcagggcgcccagcagcccccacagcagggccagggcagaccgcccgcgcagccccagggccagtaccaggcgcctccgcagggcgcccagcagctcccacagcagggccagggcagaccgcccgcgcagccccagggccagtaccaggcgcccccgcagggcgcccagcagcgcccacaacagggtcagggcagaccacccgcgcagccccagggccagtaccaggcgcccccacagggcgctcagcaatacccacagcagggccagggcagaccgcccgcacagccccagggccagtaccaggcgcccccgcagggcgcccagcagcccccacagcagggccagggcagaccgcccgcgcagccccagggccagtaccaggcgcccccgcagggcgcccagcagcgcccacaacagggtcagggcagaccacccgcgcagccccagggccggtatcaggcgcccccacagggcgctcagcaatacccacagcagggccagggcagaccgcccgcacagccccagggccagtatcagacgcccccgcagggcgcccagcaacgcccgcagcagggccagggcagccggccgattcctagaggctgccttctggtcactggggcacggctgaaaaacaccatcaacggcgggcagcgtctcagtctccagctggcggacgagaacaattctgtgttccaggcatatcttcgggagctggataccagaattgcaccgggcgttttgctctccgatgcgcagatcactacgcagaacaagggcggtgtagtcctctatatactggaatcgtatcaaattgtgggctcaccggaagaaaacgcagcataaggagttttgcattatggtaaaaccgatcaagcagtttgagatctcatccctgaaggtatcgggcttcaagtgctttgcggaagaacgcagcttttcgtttggtcccatgaacgcaattttcggccacaatgcccaggggaaaagcaccattgcggacgcgatttcctacgccatcaccggagtgtcctttttcggcagcaaccggatggacaggctccgcgccccaggcaaaaacatcagtgttgagcttcagatcgtggacggcgaagggcagccccactgcctgatccggaacagggtcggcgacaacacagatgtcttctgggatggacagcccattgcggcaaaggacctgaatactgtctttgcggaacgcgacctctttttggcggtgttcaatcccctgtatctcattgaggtgcttgggaacaagggacgcgatctctttgaacggtacatgccggaggtgccccacgaaaaggtaatggaacagctgagcgaacacaaccagagcattttggctcaaaatcccttcctttccccggaggccctggtcaagcagacgcgggaatcgatccgggagctggagagcactttgacctactgccaggggcagcaggatctgcttcgatcccagagggagcagtccggagtgctgctggcggaccgccaaaaggagcttcaggattgccgcgtacgaatccaggagctggaatccatccgcaccactggctttgatggctccgatttgaaagaacgactggccgacctttattccctgcacgaagaatatgtgcgtgagcaggcgtccctgccgcagacagacgatttagacgccaagttccgcgacctgacgcaaaagcgggcaaagcgtgaggcggatgtctatcacagccagtacgcccaggcccttgctgacacacagaagcagatcaacgagctcggcatggagctggcccgccaccggcacattctggccggcctgcagccgggtatccggtgcccgatgtgctaccagacggtaacacaggaaacgcttcccgccctaaaggatgagttcgaggcgacgatccgccggatctgcgcacaggggaaagagctttccgggcagcttgacgagctgcacggactggacgaaaaggccagagaggtatttgaagccttccgggcccaggacatcgccatgtgcaatctggagcttgccgatatagagctccgccgccagcaggcggtcgatgctgtcagggcggaaaatgagcgccgccagcagaaaatctcggagatccgagaggagatccaaaatatagagctggatctggagacggggcgcctctcctcggaagaaatggtggaactggagtgcttcaaggagcgcgcaaaggcgctggaagcggaaattgaggtgctgaccgagcagcaggggagttccatgggggccgatgtggccccgggtatcagcgcggaggaaatcaacgctgagattgtcaagaaaaatgagttgcttaccgcgctttccagctacattgcggaacgggtccggcagcggtttgaccacctggacctgaatcgcgtctccatcagcctctatgaggtttccaagacgaccggcgaggtgcgcgatgtattcaagtttaactatgaggaccggccgtacgtgatcctctccctgtcggaaaaaatcaaggccggtctggaggtatccgaactgctgaagaagatcgccgggatcaactaccctgtcttcattgacaacggcgagagtgtccctgtgatcgacaatgtgaggcccagcggacagaccttcatctcgcaggtagtcaaaaacgaacagctccgtgttgagattctgggcgctgcgccggcaggccggagcgaacaggccgcgtaaaggcggtgtcgcacggatgggcaggcattacccgcacgatctatatgaggaaatcccgattttggaagcagcgcggcggtgtgggcttgtcctgaatgatcgcacgctggaatgggacgaggtggaagcctcgtgcccattctgcggcgatcgcggcccggggaaatatcatctctccctcaacacacggaaaaatcaataccgctgtaatctatgcgaggcttccggaaacagcgtatccctgtacgcgagaatgaacgggacctcttatcggcaggcgcatgaggtgttatccaaggatggaggcatctaccggtttcctcagcagcccctgtcacaaaaaccgcccgagccggagccaaagcccctggccatgcggcatgatgtttactatgatatgctctcccatctgacgctctctccgaagcatcacaatgatctgctctcccgcggtttgtcagaggagcgtatcagtcaaaatatgtaccgcagcctcccaagcggcacgtccgcccggagactgctggccggcatgctgtctgattttcatgacctggaaggaatcccgggcttctatgtggataaggacggcttttggaacatctccggacacagcggcctcctggtgccctactgcacaatggatgggtatatccagggccttcaggtccgtctggacgatgagaaaaacccggagcggaagtaccgctggctcgccagccggggccgcccccacggagtccgatgccccgcgtggattcatgttaccgggaatcctagcgccacgaccgcctacctgacagagggaggtttgaaaggggatgtggcgagctttctggatgatgacgccttgtttctgtgctttgcgggcgtcaccgcggtcaagcacctggaggatacgctgagacagatggagcagatccaggaggtagttatcacgctggatatggacaagctcatgaattggcgtgttcagaacgcgctgacgaagatcattgcgctggtccggtccattcgtgggatcaaaatccgcgtgatgaactggaatatgacattcaaaggcattgacgacttctatctcgcccgcaattatgcggcaaagcagggggtcaacattttggatatgagctccaattttatcacgatctatttggaggacctgtggaaacgggagtatcccaagcaggaccgcggctttatccacacctgcgagtgggaagagctgacgctcccagtcaatgaactgacggcagacccgcccaaagatatgcggaaggccaaaaactatctgcggctcctgcaggaagggacagcggactttccacccctggtgtgcgtcaaccgcatggtgatcgacggacagcaccgcttctgggcctaccggcaggccggctttcaacaggtcaaagtctatcagaacaagccgtgggccatgcccgcggcggcgtaaaaggaggagcatggagatggacacacaatctatccgggaaaagctcatggggcgcgtccagctcatcgagcggcgcaatgacaacaatgagagcgtgatccactgcttcggcgctctggggcagtctggcgtcgcagaagcggatgtactccatctgtgcggcttttacggcattccataccatgggagctggacggtggaggccgcaagcgatattggcgacagcttttacctccggcttccgctgggaggtgaagcagatgcttgagatcattgccaacggcagcaacacctacccctaccaaaagagcacgctgagtgacctgtacaggctcctggagacctacaccctggaccctgtattcgagcggtatggggaatttgtcaaccggactccgtgctggatagacggtgaaaccgcccggaagtattcgggcgcgtctgtgatcgccggcaatttcctctcatacagccatgcgttttatctcattacggatcaggaagagctgatccgctccctggagaggctgatcgaaaagaacagggcttctccccaataccaggccgcccgggcgcgctggctctcttctgatgacaggccgcaacccgatcgccaataacaaaccggaaaggatgaatctgatggagttcaaagattttcaatatctgacgcacggagatccggtcacgttcctgcttgcgtggaacatgcttctggaaaacggccgcgtctcgcttcgggaacacgatgtatccgatctggccgccggcctccaagtgaggatgtccaattttatgacggaggaaaagacccgcagcgtggcggaaaccgccaaagggctcgcggagctggagcccagcctgatccttcacttccttcagcgcgccagccacatcatcacgctccccggggagccccaggagggacaatgcccggtttgcggcggagggctgaagtaccagacccccgtagtagacggccatgaggtacgcagacgctaccgttgcgaggactgcgccgccaccggggaggaagtgctccactggacctgtgtgggccatacgaatgttcacaccgccgacggcgagcccttttcgccctccggcagcgaagcatgatctccttgaagcgcagcaaagagggcagatatagattttaagggaggcatttcaaatgaatcagaccaataacaccatccagttcagccagtttgcagccgtttccaaggacagcgacgaggtgctgggcaagatcctctactacaccctctccagcattttaattgaccgcgaggtgctggccaggctctgtgataccgtggacttcccctataagcccatccgccgctcctctctggcggacgcgttccggagcgccaccggggatatttaccacaggctggtggtcaaggacgcgggcgttccgcagatcatcaatgtctactgcagggataaccgtgggccgaaggggatcatctcccgcgagctggtcaaggagacacttcatgaggataccaacgagtacaagaagctggcgaatatcagcctggaccggggcagcggcgtattctcctatgacaacctggaggccgatcccaatgtggacgcgctctcctgctgccaggacgcgcaggagctgtttgcgctctaccagacctgcgccagccgccggcagatcgacacgctgctgcaaaactatctggacaccatgcaggcggtaaaggcggcccgcgggcgcatctactttatccccagggactatatgccgaagctggcgctctttgaggacttcatcgcccttttagagcagcacaatcagcataaatacgccgaccggctgccccttgacgccaacagtatgttcgtagtggacgatgaaaagcagcggagcaagatggcgctggccttctaccgtacgatccaaaaggatttggcagagtatgaaaaaagggccacccatctcatccaaagcggcaaccagagtccggccatcatggaccggatggtattgagcatccgggagctcgagcggaagaaaatttattacgaatccatcctcaagcaggagctccatgaggtggatgaacaatatacctctttgcggtatctgtctgatgaactgcagatccgcgcacgcagtatccaggcgcagaagcgtctggcggcataaccgtgtttgagccgggcggtcctgataaggccgcccggccccttatattccctgccgccgctcctggctacccggtcttgggcctttccgtgcgctcagcagccggaaggcgggccccgcagtcaggccgacgccggatatgggaagcatccctgggaaaaccgccgggcacaaaagcagtttcgcagatagtggaagggagactacgagaagatggcaaaacgagtcttggcggactttgatctgttcgcccacacctgcccctatttctacaacggagcccctgtcaacaacgggtacgggtgcaggcacccggaatgcggggaggacgaggaggacgatgccggacagccctgcggctgctgccaccgttacacctgcccgatctgctgccccttcggggaagaggacctggacgatccagagcttgacctggacggccggggccggcaggaactttttgaccgagacggcggatttgcagacggcggggagctcgtcaccgttgcatcaggcgatgaagcgggtgaagaggaacgcgccgcgctgcttgcctataaccgctaccttcaccgctatgacaaggaatggctggaaaagcacccccggcaggagccacagtctccggcgcgataaaacgaaaagaagggtgatagtatgagcagtatgcagaaaaaccggtatcaggagatgcgggagcgccatcaggcggaggtgaacgacttccccctgatgttcgcctttgatgcccggcagttcgcggaagggctgcgcaggctcggccttcggtcctccgacaaagacaaggtgtgcgccctgcccggcaccggaggtttctgccgaaagagcgatttaccggcgctgaaaggcatgtttgcccggcaccatagagagcttcaggaggccattggcgcagaccctaccggccggggattcatctacgagatgttccgcacggaactttccaaccacgaatatgcctacacacaggacgtgtcggagacgctggcctgccttggcatcacacagcagatgctggaagctgtaccgcagctccaaaccggcctggcgctggcgtgcagatcgcttttgaagcatgcctgaagggcccgggccgcgtccgcggcgcgggacagggcgcgaaacagccggagagatatggccggaccgaagcacaggggggaatttgatgcaaaaaaacagattccaatattacatcaagggatacaggtacgctccggagagctttcacgcattcaaggggctttccgggcataggccggtagagatccctctctcagacagccagaggcagcagatgggctatctgtgcgtgacgcagagtggaaaggccgccatagattatgtgaaacgcatcgaacgggccagagccagaaagccgaagtccttcgtgacctatggcttccaggtcagagaagatccccgtagatacgtctatgcccccagcctgcgctgccggccggacgcgccgctcacagagcggcttggcattctgcgtgaattgagagcgcagtttgccctggacggcggacgagtggagcagctgaccgaatgcaagctggacgggcgctttcgccccgccaatgtacggcggcgctatgtgaccgccgacctgaacagacctgttgtggtccacctgcgggcagcttaaccaggaagaaaactgaatttcataaggaagacatcgccatgaatcaaacttatttccatggcttttccagcgacatggacagcccggaggatatctggagtattccagacactatgactccattcatgggccggaggaatccccagagccgaacgatccggagaaagcgtgagcggaaaagggccttgaagccgcagtcccgcacgcggggccgcgccgccgctcatccgctggagatccttttaccaaacggaggcgtaaagcccctggctttagccatggggagtgtcaaacaaatatcatggaggaatggaacatgaaacagctcggaaatctgtccatcgtatgcgccaaacgccccgacgtgctgatgcaggtctatggcggccgggtgagcgtccatgtgggcgaaggaccggagcgcgccaggatggacgccgcatgggacgatgataagatgatccagttgatcatccgcgaattgaattttggccgctatgccgctcccagccgtgggaaagcggcctgatgggaggaacgcggccatgactgactttcagaacgatatgtaccgccggtatctcgcatccgggcaggcagagaaggcggaggcgttccgccaagccggcgcggaccagcgcggcgccgagctggcgcagacagaagccgaggtgcgggaggcggtggaactgcacgtctactgcgatatgtgcctgagcgatattcaatctacctgccgctgaagagggatcaagctcgggaagagccggagccggatggaggcggccctaatcgaggccctcgtgaaagagcgcatggaaaaactgtaaaactgcttcccgcggagccgccctgctgggcagggcggtccccgggaagcgggacggcggcgcgggcggcggagacccgcctgggccttctggccgacagccgtatgcgcaagggaaaaatcatgtgccacgctctgtttgacgcgctgtggaggggcaagccgaaggcgcgccggaagcgggacgccctctatgaatggctggccggacagatggggctcccccttgcggactgccattttgggtactttgaccttcagcagctgcgtcaggcgtaccggctgctctcagatgtccaggggcttcccatgcggtatgataaccgtgggcgcattttctttgaagagcgccgctcagcctgacagacaaaggcatagcaatggttccgaccggtcactccgctgaagccggaaggccagggaatatcctggaaagggtatgcggccgcttgctaaatccctgaaaatccggtacactgactatagtgaaagaacggaaactggacctgtgcgccgggaaagcggttttggtcccgaggccggagctgtatgtggtctataccaatcggcgggaaacgcctgatacactaccgctgtccgggctctttgaaagtgctccagaggatggcagggtgcagcacatggagctggccgtccagatcctgcgggacgatggaagcggcggcggcatcgatcaatacgttcgtttctgccagatttccgacgagatgcgtggaaggcatggtgcgacgctgaaggctgttcaggaaaccctgcgtgagtgtgtccgccaaaacatactggcgccatttctgctgacgcgggaaaaggaggtttctgacattatgatctcgctctttaaccaggaagaaattcaagccatccacgactacaatgttgccaaacaggcgcaggaaaccgctctgaagcagactgtactgctcatgcgggatcttggcgtggccagagaggaagccgtgcgccagctcgcgaagcggtatgaccttctccagaacgatgcggagacggcggtacgccagtattggactatctgaagctgggccgcatatgttccaaccgactcttgaggggaggggagagataggcagcccgtttccttcgccggtcaaaatctgcggtgagtgttaatgcgccgcagagccggttattccatcataaacaaaaaaggatgtgagagtgactgctctcacatccttttttgctgcctgcggcgcagggactattcccagttcagaggggggactgggggcgctacgccgcccttagaagagagatacgttcccccgcactttcacaaggattactcacgcggaggctcatggcgccattccgttcacaaaggttacttcggcgagccaggtaccacacaggtgtatcaatcctgaacggctccttaaaagacagatcacgtccctcatacggagggaagtacgtcccccggactccatcgcccgggtgagctttaccagctcttttataagataccataatagtttgtgggcgtcaatattatcccgcttttcctgtgctatgggaaagagggacaaaaaccgtgaaaaaccagcagcacggcatcggatgccgcgaaattttgtcccggcgcttgtgagggacagacgccgatggtataataaaatcaagaaaatagggcatgtggtgcgaaaggagtgacggattatgaaaccaaagctgttggcggtatcggctacggatacggtgcccgctatcctgtgcgttgcggcaactggctccgatccagcgcagggctcagataccagcgttgcggcggcgatgctttcaagcaaattgtttttcgacggtgcgggcacacatcgtccacttcctgaaagaaaagccgggcacatctctgtgctgtccgggggcagcagcgcagacggcgcaggagtggccgggaccgtggactatcgtaacggtcaagcatggaagaagttccgcctctctggcggcatcgcctctttcgccagacaatggagtacgggaatacagctcaggcgtcggccgaagcgctgcagagcagcgcaatgtgaaggtcggcagggagccatggtatgcctgcgcccgaagcgccggggactgcttcatccgctgtcggtccagggcgtccatgcgtatggccggcctatggctctataaaagttccccagttttatatgctcaatctatgaaaagatgtgggcccgttttgcgggtctacatcttttgctttgtctgcttttatgcctatcatctaaaataagtaagataccagataacggccccggagcctgcggactctctgcccaaagtaccatgtcttgcgcggtcatggcttttcccatgcagccaaaagccaggctggtatccaccgcttggaaatcaggattccgccttcggtacagaaagcgccaacattggtgaatactgcttccggcacctcctcaggaatgagctggcggtaaatgtaatcgcacacagcgttctcaaggaagagcacctcaagcccggtctccgggatcaggcggtagctgcgccgctgtcccacatggcaactgtgtacgctgtaaagaagcagtttttctccagagcgtttgagccgccccagcgtctccattgccagcaggccaaagggactatatgggtctgccacatactccgtaaaaccgcgctgtttcccccagtggtagttccgcaggatcgctctccggtaccaccaggcgttcagaaaattgcagcgtctcctgcgccctgaaataaacagcatggtcctcctgggctccagagctggcttctgttctttctgctcctcttcatccatgaaaatgatgtcctcaatcagtttgacttcagcaccgctcacagattcctccggtacgagtgactgctcaaattcctctatctgcttgtccgcgcagagcttccatttcaggtctttgaaaaagcaggcaatataaaactttaaccgttgatactgattcattgttcccccattcagatgcagggagacgccgcataccgggcgctgtgccaggctgagccaatcccctgatgagatccgccgcagttgtgtagctgcagagtgtgtaagccgccgggcgtggcgcggccgccatattgaccggggtggccgggatattgacctaccaattcctgccgagttccgctattcttatcaatcggaggtgatttttgtggaactgtcgaaaaagctgtcgaagaacatgaaaacgctccgtgggagtaaatcacaagccgcgttttccaaagagatcggcatcgcaaaggcgaccgtcaattccatcgaaactcagcgcgcctccatacgtcttgatacgttggaagttatctgcctccacctcggcattccccctcagagcctcctgtccgatgagatggattgcatggagagcggtatgctggagtacctgctcgggcggaccgagtggtatttgaagctctctccggaggaccaacaggcatacatacagtggctccggcataccgccgacctgtttgaacgtctcattggacaaaataaggaacggaaggaatgatcgttatggactaccacgccattttgctccagcttgggattacaccaaattataagggctaccaccagatgctcaccgcccttgagatcgtcgaggccaacccggaggcgctgacgatggtgactaagtggctctacccggccgtagcgaaacggcaccagacaaattggaaacaagtagaacgaaatttaagaatagctgttagaactgcttggggtactaatcgggatttcttgcagaagctttctccacttccggtgaaaaagcggccgacagtatctcaattcatatcgatcctgtggaaaacagatacttaacaggattgaccctatacggaattatcttaaccgtgctaaaacgattctttaacaaaaaaccgacagtttaggggtgccttttttatatattactgtgactatgaaatttttatcccctatataacattctatcatgtcttttagctttactaatcccaattcagcagactcttttcgtgcatataatcttaaaggaggttttgtgataaagtcaccgtcattaaagagttcgcgggaaaattgtacaatataaccttgcagagtatctaaaacagtattttctgacaatggcattcttataatttctgctagttttgaaattgaatgtttgattttgccttcacagatcaatttatctaattcacactttacttctgaaaaagtcctcactttttcagcatcccaaaaaccgcaatgtgcattcacaaaaatattggatggaattgaaatggtaacctgaaaagaaaatgtgacttcccccatcaaaatggcttgaatatatttcaagtcatcttcggtgctaggatatatatcttctgcatcattttcctctatgtggaactttgacactgttttcaaaaacggatataaaacaatttttttattctctatatatccgcctttcagtagatcataaaaagctttttcaccccacatccctagttcgtttttagtcagttcaccacgaaaatacttatttagctggtctgaaaattcaaataaaccaaattccatttttgtgattctccttatccaaatcccaaatatgataatcattgtttcaccataagatcaatggggataaaatacttcaataccttcaccatgataaaaatagtttgttccgtctgtccagtaatttctttgataaattgttccatcaggcgaagcccatttttccacaacttttacccactttttggggttaaatccattctcacgcaaaaattcaatgaaggatttgcttttaactggtaactcttcaggcgcctcaacttcaatccagtcatcagggacttcctgtaatccctctttatagtaattctccttctctccttcatctgcgaaatgtcctgaccctgggttcgagttccccgatgctgcttggattattcccttcaaaatctcgttggctgcgacaccggtaattaaaatcccgccaccttcaagaattgtttgcccggatattgctgcaccgcccagtaccccgagccctccagatgctcctgccagcccgggcagcaagggggggaccatgaaagtgctagcagcaaaatctgcaatggcgccaccaatagtttgaaggccagcaggtatatatggtatcgtcgccacggcagcaccaactactgcaccagttagaattgtttttgccgcctcaaatccatctctaacattcccggaattattgtcggccacagaaatggccaccgttgcaacagcagcaccaattgctgcgccaataaaaatcggtgcaacagccgggaaagcaatcgctgtagctacacaagcaacgacaacaagcgccccaaaaagcatattgccgatccagccacccatatcgaactcattcggctcatcgttaaaggggggataggtgtgaaattctgtaccccacaaaacctcggatgatcctttcagattaaactgattttcaatgttcacgatggatgaatcgccacccgtaggcggattcccacttgctgttcctttagatacaattaacgccaatttagctactgcatcggtagaacgaataatactgaccgtttgtggtgtctggagtttaactgttggcgctacaattcgtatgcgccctctggaagtcatttggagtgcctttgcgctttcaaacaggagttggtggagttgatctagattaacctgattaggagcatctggagccccggctacgatccccatgctttctgggtaaagaaaaagctgcttgccatgctctgttgtgaaacagcgcatacttggatcacccattgccgcacagctatcaccgttttctcgcgggctgttcagaacaactgcatggccgccatctccgtcctgaaggaatagagatgcgcgagtaccaacctttggcatacaatacattatattaccactctcaggacgccaagggaaggggtatcctccggtatccttcccattatcaatatccagtgccagtacaaccctttcctgtgaggtacttttcactgttccaacaagagaaagccctaccatttttcggttttgatatgttttttcagcgactagtcctttccggccgagtatatatgtgaaaatgagctcgccatcaacgaattctccagatacttcgcaaatatagatgggcgccccttcccataacacagaactccctatgctgaggtttttagtctctttcacttgatagcatagaaaatcaggcttatacaatccggcctgttctccgcccaatctgtaaaactgccgatctactttctgaatatattctgaatttgtgaaatcaagatccgtggtgcggccctcaaggccaaccgtaatttgtggtacaggagcttcccgtgctggaaataccttcatgttcaactcgctggccattcgcttgataaattcccagtcggtttccttatattgaaatatggggcgaccaatcgtgatgccttcaccagccgagcatatcgccgcagcgttaggagtatcctgtaatacggtgcggatgagctcggcataggtcatatcaggattttggaaagaacggctttttttcttctcgtcaagtttggcggaaagcgtcacaacatgtgcctctgccagatactggcggtttatttgatgcacaaataaccgcttaataaccccgataaaaatagggatcacgccaaccatcgttgaataaatcccaaatggctggccttcaaggtctttgtagaccgctgaactgccactatcctcatctaaaaaaccagtaacaacgaggtgaccatgttcattgcctttgattgagaacgagagcttggatacagatttgaattgaattggcccttggagaagaaggctgtccagacatatggtacccacaattccacctccactattattctgcaacatactgaatccattttacgatgcccgggccactgtttgataaaaaaccactttgaaaaatctgctcaactgtaaactcatcagcaaagccatcccatggatcaaagagtttaagtcctttttctgttctgctcagtaccactgaatgataagacccatttaatttctgatagttcccaatgacacaaccggagcaatccaagagatcaaaaagagattgtccataaatctgataaagggaatgtttatcatcatattttccgagcgtccttatcacaggtgtttcactgtctggatcaccggcgattacatatttaagtgctcgctccttgccaacgtctccctctggtttgtcaccagatggattaaaaattggactccttgctgcttttacaatgtcatattgccaagcatctgcaaaaatatgttcgcaagacttcctaacgtaatcccaacgaaaaccgaccatgctctctacaataatgccctgctccggtttaatagggatactttttcccgtagacataagaaaatggaagcctacaattttggctgcggtagcccaacaccagctcacatggttttgtatatagggagcgggcctttctctcatagcatcagtcatagattcaatccaacggctcgtctgggtcatactgctgcccagaattgtagggctcgatcaagccgccatacttacaaattaggaaagaaagcgtagttgtagtcggaattccttgaggagacgctaaagcctcggcctgctcttcgtctgtaagttctgaaaaattctccggcataggtttgactcttgcacggtcagcgggatctaagtccccattatctacaataggagtctgttcataggcatccatccagacagcgcctacgatttcgggctggcatttgtgcccgctttcgtgtccccctggcgcatccccagtgcggtctcccgtctgagggtttctaggcacatcttttgtgagatgcacgacttccgtgggaggcggagacggagctttacatattccataccaagtgatattttcctcttcccccacaaggcagttacgtgcatgaatgcatggatgaccgtgcacatatataccatggcattttttcaagttgagttgtcttgcatgggtaccgtaacggcagcgaagcaatgcaccccggaccaaatattcctgctttccactctctgtatgttctttcaagaaattagcaatatcttcttctgttttgaaatcatgttctgcaaggaatttgtctatatctgattgtccagtcaataagtattcagtaaggtcagagtttgcaatcgccgtcaataacgaagtcccaatatttctccttgctgctggaatggacagcaatgccaggactgcgtatgtcttcggattggttgtcactttccccaacagagacaatgtgttgtctatcagtatgtccatgctcgtttctgttccaccaacaggcggatcgccactgtaaaactcctgaagaagcgccatgatgcccaaacatatgtttgcgcgcatttctgggtcatcaatcgacattattgcattggatagatcccctactgctttggctaaaggcccctcaattgtctgccgctgtaagtgcccatcatccgttaataacgcagttatataatgattcacgagcagcgattccatctcatccgttggaatcgtcccaatatcaggagtatatagatagaccgtgttttcaggcaatgtgattgtctggcctaatccatgcacatagtcgttgtcggcatggatagagtatagctttttcagcccttcttcccagccaggtaaatccttaagctgctctaccacgtctggaggaaacccttggccgtcaaaattatatgccgcattgatcttgtcagcaaaaactaaagctgctagctgcgtctcatttccacccttggaatgtccgctgatattgattacctttccctcattcttatcaacaatgctctgcatatactccaacgcattatgctgcataggtgagactccaagatttgaaactccctgctctgcattttcataggggagcagatagtctccaccggccattccataaccattgtcaatccatgcaccatcaggagtaccgcgaaagcacacattgatttctccattaaactcgaaagcacatgcttggaaacctttaatattaaattgtgttccctcagtatcccaactcttatctacaatttttgcatctcccaaatctttgtaggaaccattctctccaataatagattcgagtgcttcaatatatacgatttcatcctctttgggtttgtccttagctgctaccaatattttagatagtgtatcagcttttttatattttgggtcatccagccgcaaatattgtaccgcttgaaatgcaatttgctctaaaacttcttcctctgccatttcaggcacaccataaattaagctcatccttcaccctcctcccatccaccaaaacgccatttagtggtgtcaggcaaaatgattacgctacagctatatttataaaatccactatctaatgtttctaaattttggtggttatctgaatttatattgttataattagcttctgatagatattctacatttacacaaattgagtaaccactattttgaatagcaattataaatttttgcatatcattattcttttgcttgggatctttgactgtaaaaatatcaacctgaactactggcgcatattcttcggaaacacctaatagttcaatagctgttgtttctttcccaaaatctggagggcaaacagaataaccataagcaaagagcttacattcaccaaaaacgtcattggcaaccggggtcaaaatttcttctaaatcatgctggcgcaaatagacaatataattatcttgatatgtctgattttcttctgaccattctaaatatacttgaaagtttggaaatcttgtcgaaattacatcaccagtatctgttaatacaaactcttctccatatttttcaacacagtactccaatttaggtaacgcacgcgaattaaacatatattcggcaatttgttcgtgtagcggttttttatccttactcatcaatatccctccagtaatcaataaagcaatcacaaaaagcatgattactgatattttcagaaatttattcatagcacattcctctatgaaaccgatatatgctgatatggatttgcaattatacagcgttccaagccaataccacggccaccacgcctcaataggctctccactaaatctagccgcgccacagcatagagcttagaaaatccgcctaaatagaaaatactccggtcctcaattttttcagggtcaagtacagcggttatcagggtatcccgcccgcgggagagttcactttccggtgccaggcaatcgcagtgctctaaaaggggaatgtagtaaatttcgcttgtcgcatttttacgatccagtaaaataatctccttaaattgtgttgtaggctcatacattttaatgacatctcggaccatcttcgttccaaggaaaaaggggaaatcaataatgtccgtaaaaatggtatcagggtttgactgtataaacagcagctcgcgctttggcaatttgtgtcctgtttccttgcggattaagcgcacatctattttcgggtaccaattttcaatcacgggggacgtgttatactttgggtcggttttcaggagaaagtatctcatgttcatccccctttctgaacaacgcaaactgaattgtttgatccatgtaaccgccgaacgaaaatctcacttcatcacagcagtctagccttgcgattccgcctaagacagcagcatccaaagattcctcaccaaagaagaagccggccagctgatacaagttattgatataggcccggcggatttcttccaactcatatgggcgaattcgtatccacatttgtctggcatctttttcaaagaaactcaagtcttcctcgactgcctgaaatagacgttgtgggcaccaaaaacacaacagcccgttctgatccaggcaatatcgctcattggtcaaagagagcgcaaaatcatagctctgtgttacggcgctgctctgtagatagaatatagaaaagtagtgaatctgtccaagcgtcccagcagcctgcctcttttgtgctgtctggagcagatcagaaacaattctatgatattcccgtttcatttccagatatgcggcgcagtctttccggagcaaatttgcccgttcggaaatgtatggagtaagcttttccctggcatattggaacatttcttcttttcggcccatttgtactcacgccctttcagtctatccgaacttgcgcacctccaaaatgtagcttttcttcaagactcatctgcgtattgccctgttggaatataatacgctgtggcgcactgatactgagggaacttgtcgcgcttgaaatgtcaacagcttcctgcgactgcacaacgattgccttgtcgctgataatcttaattccctctgcatcagacagttcgatggacatcccggcattattggtaagcagcaagctcccaggggtgaaaaggatttccttcttctgcttgttcatgatggatttgaagtcagggtttatgcgctcgtcgcctgcggaggattggagatggacggagcttgccacatatgcatccgcgtccttttcacatggaaagtacagcctgacagcatccccaatttcaggcatacaataccagccggtcccatccggagtggagtacactgtagcgtacgggaagacgcgggtgccgcagcctgcttggttttcatcacatccaatcaaaacctggacagtatctcgctccacggaagttacctgcgcatcaagagagagcccaatgagattttcattgaaaacttcctcagtttcaaatccgctctcgctggtcaaatagtatgtatggtacagctcgctgccttccattttggttttaatggagtacacacgcagcgggaccccgttcaatgtcacgcagtctccaaggcggtagatttcccttgagttcagcacataaaagaaagtatccgctcttggcatccgctgatcttcgctctcaatgatttggcccgcgttttttgcaatcgaaaatatgtttgtttcaacagcataatgaactccatcttcgggaagcccaaaggtatatgcgatatggtcgcgttgtgaatcaggtatcacaacagtatgaaagcggcttgccattctctttataaatgcccagtcggtttcatcatactgcataacaagctcaggaatatttgagcccgctccctttgccatgatgaaaatggaatcggtatagccattattcacagtcgtcaatagattttgatattgtagtctgtctgcttggaacgaacgcttatgcggaatcaaatccagcaagtaggtattcgtccttaataccccagttaaatatctaacatcgttttgagcctgaatctcaaagtcaaccagcactccttggaatagtatcttttcctcaccgctatcgctgcaaacattgactgaaaccagaggattcttctttaacgcccaggagatatactcgctctctttttctccgcgcatcagtcctgagaaaaccaattctccatgttcatttacctgttgtacgccttccagctcagtaatcttgagatcatcgaaaggaattgcctttatcaatacttcccgcatagcgaacacctcctaagtatccattactttgacggattgaatgacttgaattgccgctcggttccactcgttcatcgagtcaaatctacaactgaatgttccatgcagaatttttcctttttctgctgccagcaaatacataatcgtataaatctggtcatcaatcgcatagcttttatagttaaaccagcacaaagcacggttttctgcaacttccgcttggagatcatagaaaatattggctggattaacttttttgagcatggctttcatctgctccgcgacacgcttcacctgatccaaaggaacatcctgtggatacacgctgaaggtaaaattcacagtcgtgtccaaacttgtgaatatcatctgcggacgtgtttcggagggatattttattttagcaatggaaagcggcatccgcacaaatgttttcggcaaggaggcgttgatattcaactctggaatatcccgcggctcaaattcgaccaattcatccttgatataaataccagtttccaatgtgctgtatttagcgtatttttcccgcctttttagcttcaaaaaatcttcatccagataggacatctcaatcgccatccttccgtttaataatactcaaggcccgcccatgctgtcagcataggcgggccttggcttggtctacgctggaaagcgcatcggtacatgattcagttttgattgttttcacattacataatggcttgttcgcagatacggtcgccgataccattgtaaatgtatatacttaatatacttcaacttagactttactcacaatttttaaccttgattccatgatctctcaatctcgtccatcagttcaaaatcttcttcggtggcatatccataaactttctcggtatccacaatcaatccaaacgcacatgcaaagaatgaaattaaactgtcggcttcaatgcctatgccatcagagttttcactgtcccaaaaataaatcttttcgttgtttccaagatataattcataggtccaagctccaactggtttatagttgggattttcccagccatctatctgttgccctgacaaagagaaaccattatagtttaacatatatccaatcggggtaacatcatcgtggaattttaagccgaggcattttgatgtaataaacaaatccttccatccactctctggatacttaaaccttaaaacaccgccataaatatcttcaacagttcccaaactccttgtctttttcatgggtaaagataagccatatatttgatgaataaattcctttacctccgaggtaaatgttaatctaaaattatttatttgagaaatcaccaacttcccttcatctcttgggaggccatcccatccccagtgctgaagaataaatttcactttactttctaacgtacacggaagttttgagacttcttggtatagtctgcctggcctatttttgatttccaaatagtttactttttggcaaatagagttgtattcctcctgacccaacggaatccaatccattatggacaccccgctttcggatttacatattgtcgtttctgctcaatatttgttagttgcttcccatatataatttcatcgattttttgattatttgtgctagacactgcacaaatatcacatgcatcagaaatttcgtttgggttgctacgcaacactgaaaaatgtttataatcatcttctgtcagtgctacgccaaaatccattctaaagaattcagcataatcttgggggcaaaattttgggcaacgtacccagatggatcaacataaaacacagggttgttcgcacagtacgtatatagattcagcccgtcactccggtaagtgtcctcctgagtaaagcggccaataaccgggttgtagaaccgggtccgcaggtaatactgctgggtgatgggatcgatctgctggccgtagtaggtgaagcggttgggaacggcctcctccttgacctcaatttttccccaggcgtcgtaggcatagcggttttggacattgccactttcatcaacgatatgggtggttgaccccatctcgtcgctggcataatggtagtatgtccgggcgctctcgctgtcgccgctgcgggcaatcagctccgagccgcggatcaggcggaccacattgctgttttcctcctgctccgccacggcctcccccttgtggaagatgaagcgcaccagccgcccgttctcctccatctcgtggcgcaggccctccgcgtcgtagtggttcacctgtatgctgccgtcaaaggtctccaccttcaccgtccggttgaaggcgtcgtagctgtaccgcgccttgtcatcccgaagcaggttgccggcgttgtcgtactggaagggcgtggtcacgccgccccgggtcagggccatcaggcggttgcgggggtcgtactggtacaattcctcctcgccgcccaccagacgccgggcgcggttgcccgccttgtcgtagaacagctcctcggaatacgccgggtagtccacccgctggagctgattgagggcatcgtactggtagagggtggtcccatccagggcctgcttccgaatccggtttccgttgccgtcgtaggcatagctggcatgggagagcagggcctccccggagcggacggtgaggcccgtcaggttcttgtccaggtcgtaggcgtattcctgccggatggggccgtgggccacggccctgggcgtgccgtccgggttataggtgtaggccgttattatctatttcacgggtactaattcattttactgttacttgctactcacctgactatatatctccgtcaaggtggctttaagttgcttaatctgcggagagagtttatccgcatccttaattttgtctagatttgtttggcaataatccatcactatttttttgtaattccgagtacagcgctccatcgctttcaaaagaaacattcggttttgtgtaatctcttcctcgctttggttaggtgagcccaacaaaaatactgttaaaaatgtttcgatgacagatgataaatacgggcgagagattgtttcatacttgtttatcgcctctgctattgcttcaaagcaaatcggagattctttctctatcacaagaatgattatcatttccattatacgatctttaagtgtccactgaatgttatatgacgattcattctctaagtctttttcaactagaaataacaagttacatagatcacttatatctttctcagaaaaaacgccaccttgctctgcacgatccattaaatcatcgaacaactcgacggactctttggaaagatctttaaggtattgataaattaactcaaaattactcatataatatttttctcctttatctaagtgcctctttataatgtatggcctgtgctatggcgtgctgtctttgttcttctaaagctaaattaactaaattaatatcaacatttggtcgtgttctactataaatatcggcaatatctccttgatcaaataacaaacggttttcataatttaatgccgaatacagtgagtatagaggattttgggaatttaatccatatgtaaatgtgagacgatgagctgcttcagtaatgttcaaactcgaaccacttggatacggaatcttaacaagagtatttcccgccggcatatgatggggcgaaatcttgtcgcctacaaaactaaagaccattcccaattttggattcttattattaagttccgcaaaagtcccaacaagcagctcattatcttttaacaaagacgtatctattttaagtttgccattactatcgagtaatttagttctaatattccacagtgtactaaatatttcctcttgtgatccacggttgagtagggcattgagatcgtcagagctaattgaagtagctaacccactcggatcaacatagtaaaccggattatttgcgcagtaggcatacagattgagtccatcgccccggtaggtatcctcctgagtaaagcggccgatgaccgggttatagaaccgggcccgcaggtaatattgctgggtgatggggtcgatctgctggccgtagtaggtaaagcggttggggacggcctcctccttgacctcaatctttccccaggcgtcgtaggcgtagcggttttgcacattgccgctttcgtcaacgatgtgggtggttgaccccatctcgtcgctggcgtagtggtagtacgtccgggcgctctcgctgtcgctgctgcgggcgatcagctccgagccacggatcaggcggatcacattgctgttctcctcctgctccgccacggcctctcccttatggaagataaaccgcaccagccgcccgttctcctccatctcgtggcgcagtccctccgcatcatagcggtttacctgcacattgccgtcaaaggtctccaccttcaccgtccggttgaaggcgtcgtagctgtaccgggccttgtcgtcctggagcaggttgcccgcattgtcgtactggaagggggcggtcacgccgccccgggtcagggccatcaggcggttgcgggggtcgtactggtacaattcctcctcgccgcccaccagacgccgggcgcggttgcccgccttgtcgtagaacagctcctcggaataggccgggtagtccacccgctggagctgattgagggcatcgtactggtacagggtcgtcccgtccagggcctgttttcggattcggttgccgtttccatcataggcatagctggtctgggagagcaggacatccccagagcggacagtgaggcccgtcaggttcttgtccaggtcgtaggcatactcctgccggatggggccgtgggccacggccctgggcgtgccgtccgggttataggtataggccgccagctcctgcccgtcgtcggtgaggcgggtgagctgtcccagggggtcatagtcgaagccggtcagcttgcccgttacgtcgacctgccgtaccttgttgccattccggtcatactccagggccagcagggtgcgcccgctggcgctcttgcgggtcatgcggcccatctcgtcatactcataggcgtaccgcatcccggcggaaatggcgcacttgagtaagccctccggggtgtattcgtaaaaatcaccctgagcgccgtctttttcctttttgaacaggggagcaccatagaggttgtaccccagctccaccgtcacgccgttgcggtcggtcttgcggatgagccgcccctggccgtcgtagtgataggtttcccgctccccggtggggtccacgatggccgagatcttccccatgcggttgtactcatactgggtggtgtggccctcgccgtcggtggaggagaccatatcccccgcgaagttgtaggcataccgctccgtggagccgtccgccttcaccacaccggtgatgcggccccactcgtccagcaggtactttgtctcgctgccgttcccgtccacgatgccggtgatgcggccccgggcgtcgtactccaactcctggctggccccgcccatgctcacgatccgccgctgggccccggccaggtcgtattcgtacttcacaccgctgcccacgccgtccagccgctggagcagcctgccatcggcgtcgtaggtattgctctggagcacgtggccgtccggctagtgaatcttacttagataccgtgctctagtctgacgtgacggcaaagattttagataagcaaatctgaatcatgtaatattcaagttcaacggtaactgtagggcaaacataatataaactgttggcttctttgaggtattcaatatattttgtaatatctttatcttcaaaccttttcatggccatataaaataatgccttcattttatgccgctcccgcaaaacaggaacgaatccttccatttgattcagtaattcgagttctgtgcattttcctaaaatgaaatcagcgactgcaaattccttagaaatgcctgtttctccctttatcctcccattaagaagcttcatacatgttttccgtgctgttgtatcgtgaaacataacagcttcatagtacatggcgcacgccacctctgtcctggaaatatcctgatactttgcatttcttccctcgtatagtattttatatgcatcttcaacttggcctaactccatttttgcgattgcacaagccacataaaacttagaggaacttcgattagatgaccctttgcgattagcattttctgagatgtgcttcatacacatatcaacaactccatgataatctttcagtcctagcagggctaaaatataattgcccggaattaaatccgcgaattccggattctgatctctgatttccaccttttcttcatataagtgacaaaattcctgaaattttctctgctcaataagcctaaatagtcccatatttaatcatcctcaaaatagtaattgtccagtttccgggtcatagggcaaaaacacagtgttaggatcataccctttatttctaatttgttcttgaagtttcttccatccagaaggagtattgggtttaaagtcaccatagttggcatttgcaggccagtgtgttccaggataatcagatgtatcagaaggatgaataccaccaacaacttccacatctacccctgcttcaccccgtctcgcgaatctaaagtcagtttgtggatacattgcagctaaatctgacggaagttttgttcctgcaccaccattcaaagaatcataatgtagataatttccaatctcaagtggcgacattccagcaagctcagcagcacgattaacagaggttgctgtgccccctgacggaatatgagagctacccatttgactagacggggttgcaacaaatttattgctccccacttctttccagcggttagtttttgagtcaaaatagatttctccatcccacatacgctgttcagaagcgaaatgaggatcatacggcaccaaacttgtgttcccaagcgcatctttgtcaaaaccactcggatcaacatagtaaaccgggttattcgcgcagtacgcatacaggttaagcccgtcgccccggtaggtatcctcctgagtaaaccgtccaatgaccgggttgtagaaccgtgcccgcaagtaatactgctgggtgatggggtcgatctgctgaccatagtaggtaaagcggttgaggacggcctcctccttgacctcaatttttccccaggcgtcgtaggcatagcggttttggacattgccgttttcatctacgatgtgggtggttgaccccatctcgtcgctggcataatggtagtacgtccgggcgctctcgctgtcgctgctgcgggcgatcagctccgagccacggatcaggcggatcacattgctgttctcctcatgctccaccacggcctcccccttgtggaagataaaccgcaccagccggccgttctcctccatctcgtggcgcaggccctccgcgtcataacggtttacctgcacattgccgtcaaaggtctccaccttcaccgtccggttgaaggcgtcgtagctgtaccttgccttgtcgtcttggagcaggttgcccgcattgtcgtactggaagggggtggtcacgccgccccgggtcagggccatcaggcggttgcgggggtcgtactggtacaattcctcctcgccgcccaccagacgccgggcgcggttgcccgccttgtcgtagaacagctcctcggaataggccgggtagtccacccgctggagctgattgagggcatcgtactggtacagggtggtcccgtccagggcctgcttccggatgcggttgccgttgccatcataggcatagccggtctgggagagcagggtctccccagagcggacggtgaggcccgtcaggtttttgtccaggtcgtaggcgtattcctgccggatggggccgtgggccacggccctgggcgtgccgtccgggttgtaggtgtagaccgccagctcctgcccgtcatcggtgaggcgcagaagctgccccatggggtcatagtcgaagccggtcagcttgcccgtgacgtcgatctgccgtaccttgtttccgttcttgtcatactccagggccagaagggtccgcccgctggcgctcttgcggatcatgcggcccatctcgtcatactcataggcgtaccgcatcccggcggaaatggcgcacttgagtaagccctccggggtgtattcgtaaaaatcaccctgagcgccgtctttttcctttttgaacaggggagcaccatagaggttgtaccccagctccaccgtcacgccgttgcggtcggtcttgcggatgagccgcccctggccgtcgtagtgataggtttcccgctccccggtggggtccacgatggccgagatcttccccatgcggttgtactcatactgggtggtgtggccctcgccgtcggtggaggagaccatatcccccgcgaagttgtaggcataccgctccgtggagccgtccgccttcaccacaccggtgatgcggccccactcgtccagcaggtactttgtctcgctgccgttcccgtccacgatgccggtgatgcggccccgggcgtcgtactccaactcctggctggccccgcccatgctcacgatccgccgctgggcaccggccaggtcgtattcgtacttcacaccgctgcccacgccgtccagccgctggagcagcctgccatcggcatcgtaggtattgctctggagcacgtggccgtccgggctgagcaccgtgagcacccgcccctgggcgtcataggtgaactggaagccgtcgccgctgtccgtttccgggtcgtactcgttggggcggatcagccgcaccacctggccgttgcggtcgtagaccgtgcgctgcacgccgccatcccgctcgatgcgccggatctcccggttgagcaggtcgtaggcaatgcgggtcttgcgcccctggttgtccgtgatctcggtcagattgcccgccgcatcatagccgaactgcgtccggttgtcgatcccgctgcgctcctcccggtgtgtctccgcaatcaggcggttggccgcgtcgtactcccgcaggatctccccgccggcggggagctggatacggatgatgtttccattccggtcgtattcataccgggtgctggcaaactggctcccacacccctcctggtccgcgctctgctccacctcgatcagccgtcccgccgggtcatagtggtagtctacccgctgggtcagcccctcgctgagcagccgagtctcccgggtgcgccggttcaggctgtcatactcatagcgtaccacagcgcccagaccgtcgctcacccgcaccagccggttttgcttgtcatacccaaaggtcagcgtgtggatgctgcctctggcactctccccgtcctggaaggacaggaagcgtttctcctccgtccggttgccgttggtatcgtagacatactgggtcagccggtactggacagacccatcctccgccctggacaccggctcccgcttctccagcagccatcccgcccggttgtaggcatacaatgtcccgatccgggcctcgtcggtttccccggccaaatagccctctgcggagatctcttggagcaccaggccacgcaggtcgtagacataccgtttctccacgaccccgtccgggctgacgatctccttcaggcggcccgccgcgtcgtagcggtagacatagcccgggccgtcatccgtttcagcgtcatactgttctggctcgatgaccttcaccagattgcccatagcgtcatatttcagccgccggatgccgccgtccgggtagatgaccttgatccgccggtcgtcggtgtcgtactcgtaccggatgccctgaccgctcctggtggccggatcataggtgtttgggttgacctccatagccaggcgccccgcagtatcatagggagtggcaaacacattccccagcgggtcggtggagctgacacggtgatccatggcgtcatactcatagcgatagcaggacccgtctcccgtcttttcatcgtactggttgggcagtaccttggcgatcagattactcaggaggtcatagcggtaacgggtggtgttgcccaggggatcgatctccagcgccctggcccccagcttggtatagccgaattggacctcgccggcgtcgctctggatggccatacactgctcaatctggttatagcggtactggaacaccgctccctccggcgtgataagccgggacacccggctgctgcgctcccagtattcatactgggtcacattgccgtttccgtccgacatggagatcatgcggcccagccggtcatactggtaggtctgcaccctgcggcgcatggcgtcgatcacctgctcctcgcggacacagttgttgcgctcatcgaactgggcgaaaaactcctcgccatcgttgttccaccagtggacctggttgccccggtcatcatactcgaactcccaaatcaggccgctgggcagctcctggcgcaccagtttcccgtcctgccggtaggtccagcgggtgatctcgccgctgcggttcttctccagaatgcggttgccccactggtcgtactcaaactcctgataggtaccgtcatcgtactctgtctttaccgcctgcttctggtcgttgtaatggtaaactgtgctgcgaccgctctgcagattgtgataggttgtctggcgtctggaatcgttgtaaaggaatacatgctcttcgccattcgccagatcctgacggatcacgcgccccttttcatcataactgttgacgagatagtttatgccattctggtcggtgacagaaataatcaggcccctggtatcatactggtaacgcatggtcccaccgttggggtacgtcaccgccgtcagaaggtccccgtcgtactcatactggacagaacgccccgcacagtctgtgattttggaaaccttgcccgcctcataggaaaagtccagatactggccgctggcgagggtcaggcgctgaatggtagtgccgcaatagctgatctccgtccgattcccatgtgaatcaacaacggcggtgagacggccagttaggtcgtagcaataggtcttgcccgttgtactttcctggatggaatagcccgcctggctctctaccataacataagccaagctctcgcccttcgcgttcacccagccccgctctgtccgcaggaagtgctctacactcaaatcgtccttgagcatggcggcctcatccgcttccacaatcagccgcatcccaagactgctcacccagcgggtgccaagaagctgcttttcatagttgctcaccgactgatgcctgcgcatcagtcggaaatcacccgcaatatccggcaaaatgaagtctgtttgctttgcaaaaaagctccctgtaataggatcgaccggatctcccggcgatttgacgataccctccgcatcatttctctctgtattgctttggcttcccatggttctacgggcagttccctctgggctctcatcagaagtatgccgcccatttgcaaagtcatcagagagatttccgcttgctgctgcacgtcggcccacaagattttgaccaagcctggtcagtgcttgtatcccacccattgtagcgactgaacgcacatttgagagaatccattgctgcaacaaagccttattttcttcggtccagccctcttgactgattttggaaataagctctgctcctgatgtaagggaaacaacccccatggcaccaattgaggccgctccaaacaatgcctctgtgctttccactgctttcgaaatgcgctgggcgctttgtgctgtatcacttagtgcatttgcagctttccctgcatccgctaaccagccaaacatatcgccaaacacgccaaacatagccatgccggcgccaatcatatcaccgcggcctactgaaattaaggcatctaatgaattggcggcaagtgcaactccccatccgatgccagggatacaagttccaattgcactgataattcccaagccaatctgaatgccgtccaggatggagtcccgcgtcgtttgatttgaaagctccacacgctcaaaatttccccgatgtgagccatacatctcatactgcttggaggagagcgccatgatgccatcggcatccattttgatccagctcccaccctcttgcggaacagacaactggaagctgtcagaggcacgaagattgatgataccagtcgtggccggcggctcatcttccgattcctttgcaggaacgctctcctcagcgccattccccgtaaataagcctgctacaccactgatcgcctgaacaaaaatgttgccctgtgtctgctgctgaaccatcgccatgtactgtgcttggctcgcggctctgtggtcctcctctgtgtaggttgggtgttctgcactgccaccgccatggcccacatagtcactgtagccggactcaaatgcggcctgcatttcagcactcttgctttcatgatttggcacaaagctttccagcgtttgagggcggctgactaaattgaaattttctagtgtgtcaaagaggatatctcctttactctggatcgtgattccctctttgcttttgaaggtgatatgtgttttttcctcgttttcctggtcagtatagtcacgtctaatcacaaattccaactgattcgaagctgcttttatcatgtgcccctgtgccaccagggtacgatccgccggtttagaaaaatccggcatttcgccactccacttgcttcccaggcaaacgatggtgccgtcgttctggtagtaagcaaatacctggtcgcctatgttgggcatgcagtaaaagtagtttccaatggagctctcataaggaatccagcgtgtgccggctgccggaccatcactgctgaattttaccaacacctccacaccctgaacttccagcacctggccagtcagcacagtgctcaacagggtggtctttttcccatttacaggcaccgcaccaacaggatcagttagagtcaaccggttttccagcaaatcgccatcactggtgattcggctccctataaccgcatagctcctcaactcaccctgcaattcacagccgacaccgatttccaaatctggagaaagaccctgctgctttgccatttgataagacaacgcttcgccgcccatgcgggcccgcatagtcataaagtcaaccaaatccttctcttcgcactccagcttaaagctgctgtagggaaaagtggagaagggctccaggcccacgctgatatgcggctccagcgccttgctgtctggatacacatacaagccctgctcattggcgatccgtactgtaaactcccaagccgtttcattgttccgagagagcatctgggcaaccggaatgtcctttgggatagacacacgaactccacagggctccatcacagaacggatcacctgtcccaaggtcttcccagtattttggaaggtctcacttctgcgctcctgatccgcaaggcaggaatatgtacgcgccgtaatcaaaagttcctgatactgggcggtatgctccagcttcaaagcgactgccatgccgctgaacaccgtgccgccatcctgcgtactgaccgtaatcggtgtgttttcgcaccgaagtacatcctcctgggtcacctccgcagggatgatcgctctcagcgtcaacaggccatgagcattcgtcattccggccacgtcaagaaaaagaaccttgatacagggaatgccaaatataagttttagatttcctaacgcgctgaattccttcatcttgatttcaccccgttcaggtcaaacgccccagcatatcggtaataatgggaacagcctgcttgtctgttcctttgctctcctgggcagatttctggctttgcgccagggtagaagctaccacatcgccaagggcaacactgccaccagaactgtcactcagcttcatagagccacagcttgcctcggcgaggggagaatcgttatgctgtaggtacagcttaaatttgtcaaactgcgcctctgagctgttgtatgtatccccgccgccagtggtcaggtcagcaaagagctgatttgccatatcaatgtcaccgttggcgaactggagcgcctcgctgtaaccatctttcataaattgggccgtttctgcatcgatttttccctcagccaacgcctggtccacagatgcttccacttctgcgtttgcctgcttcatgtccgcctgcacttgctcctgcgtcttttcggcaccctctccatcgttattttcgggttcagtgacttcaatggttataattccgccgcgtttgcaaaaaagcattcccttcattagaaggaccggagcaccgtcgatgaggtaccgatcatctgtttcataccatacttgatcaatgataggggcgcacttctgtgctgtaaaaaactcaaccacaccactccagaacttctcaaaaccttttttctcaactgcttcaccagtttcaatgttctgctcccggggagtgcagtctccaaaatgaatcacattcacatcaggccgccaatcgtttgcatttagaactggctgtgcctctgggccaaagagtactccatgaccgcccccggcctccgccacattaagcgggtgattcatagagccatagctgcatttggcagatattaagcggtagacaaattgattgtcaggctgaatatggttggaccctgacatcgttacctcacctccacaggtgttaaatcgaccccatagggggaacgtcgcagaatactttctgcgacggagagctctaccacaacccggtactcatgcattccgccgatacggaagataggctcaggaggaagacacatccggttcagcacaatctgtttcactgagccatccggataccgttccacattttcatggagacagaaagccggagggaagtaaggcaaccaatatcgatagctttcccggctgtcaagctctcctgcaaatagctgaatcatttttgcctgcaaatcagggatatagagtgtaaagagctttttcagctcatcgctgatcaaaaaagagggatcgctcagaacagccggaagttcctcgtgtgcttctgcacggaaatacgcaacaatcgcctgatccagatggtcaaatacatccttttctgctgctttttgatactgctctggaagcccaaagatagaaagcggacgtctaagtctgctgctggcgctcaatctgaagtaggactgcataatttattcacccctagatatttggcaaaaggatggcgaaatcagatgcctccgccagggtattctccatcacagtataggtggtcgtgcattgctccatctgtccgcccctgagatcgcaatcagaaaagcggacatgttccatggatgtgagcagcatggacaaggcgcggtaccaatcgtccattttttccggcgccatacctgctatagaggcaattacgcgctcaaacaccacattttccagggtacactcccgaaactgcgccccagcgagaagtacatctgtaaatatgacatttttgaagcggcattgctcaaacaagcagtcacccaaagatgcttcttcaagcgtgctgtccgagaattcacaatttcgaaaaacagaaccttttagattgaatttatagaacttcttgtgccgaaaaatcttgtcttgaaactgacggtgtgggaactggcgcccccggctgttaaaaagatcaacctccgggtattccgcggctaaaacaatcttccagtccagaaattcgccaaactcaatcctaaactcatcgcctttgaccaaggctctaaaagctcggtcatcctttatgggggccatatgatatttaaggagagatcccatcatgctaaacagcggaccagtacatttccacgcagcttgttcagccaagagcggatagcagaattttttgatctcctgttggtctagtacggcctggaaatgatcgtttagctctgaccacagcggtgtgagccagggacattctacaaaccgggtagtaagcggtcggtcatatagaggccagtcttgtccatatgcatccaagcggtagcctggctttccacacagcaatgcggtgcggagcacagagatagaaacacaaaacactggttctataccaccttggcgctgcttctgacacagttctttgagaaatccggagagtggtacaacaaaccattcctccgcatggacagatagacgttctactagcatggttacggctgtcccagccgcatccgcaaaatcctgctgtttcaatactgtattgtccatgctcatccctctatttattccacaatgacttcttttcccaaaagggtaatggtctcatctgtaatgtcgataaatgcccgatccgtccccagggatattttttcatctgcgatcaatttaattgtttctgcttgaacttttacctcgccctccgcattgacgttgagatctttcttgcaggaaattgtaatcccttcatctggtgtaagatcaataaaagcttcctcaccatcgcatgagattttaattcccttctcggtcaactggatacacttgccgtgagccatccagaccttatctttagggctctgccccataaagcgcggagcggaactggatgcaaacgcctggccttcatttccagacgggaaaaaaacacgtactgtatctcccacctcaggcatacagtaccatccactctgatccgatgaagagtatgcggtggaatattcaaaccagtgattaccgctaaattctgaatcgaaagagaactgcacctgcaccttacttccggacacgttcttgactgtgccagtaaacattttaccgctgcaattttggttcacgccagcagaaacagcaaggccctttacatctgttgtggctccagcagtcggagcctcatttcccattggaagcaggccgtagttcatttccaatatgccgtccttcatctcagcagatatgcttttgaccgcataaaacctggcatccactttcacgaaatttccggcaaacacataacagtaagatttcagtccagcatcagaggcatcctcgctcaccacgatttttcctgtctgcatctgattgctcatggtgctctttgccatctgaaattccgcagtgcttaaatctttgacctggtcagagggaggaagtcctacataaaggtgaggttcatcggcctgcacatcggaaaagacaggcgcccccagctgggaagccatgcgaatgcagaaatcccagtttgtctcgtcgtactgaacaatgagttgtccagtctgcttatctgtaacggtgatttccgctgttccttctccggaaatacttttccgaatcaaatccccataggtcgccgtagtgtcctggtatgaacgctggtgtgtttgaatatccaactttttacaggttccttccagcaccacagtaactttggcgtactcgttctggtgatttaccgaaacattcttgaccacaccgcaaaacagtctggccggctgcccagacgcagtagtgacaacctctgtctcactggattcgtccgtcctttgggcaatctcgtctgcgctttcgtgatccatctctccgacaatggtgcaaaggccaaacacattggggccatgatcaatgttcaggttgagaattttggtaaaggggaacagccccaccgaaacattcagatgggaaataacctccatctcattcatcgtcgatcccctcctccgcagctttctttggaatattcagtgtttccatcatttcttccatgattggctggtaccgctttttcaatctggaagggcaagtaatacatccaatcgttgtcttgccatccaacgaaaaaacaaacacttttcgatagctcggctctgtaatcgcttgcgcgatagcatcaaaccaacgcacatagatgccgtgaattacctttttccctgtagaaaggatacggatattcggcccgacggtctttaccgtatttaccatatagggaaacatctgctcgatccgagcttcatcaccttggatctccgtcagcataaaggtgagtccaaagggaaggtagggaagttcataaacaaattgaggtttactctccataagaaactgttgcctcacagcgtcatccgttagctggctaagatctctcggcgcccgcattacgattcggccgtccagcaaatccctctcctcaaatactacagggattttggtaatgtgggtcaccgggtcatggatggattctttcagttcctctgcaagtgtgtcctcagaaacccgttgtttattaaactcttccgccttctgccgcagccgcagcaattcctcatccttgtatcccatctatctcgcctccggtcagtccatcatgatgctccaagatttgcgtttcgccgacgctgcccgccggtccccgttaaactgtttcaaacaggcgataagcccttgatacaggcgaaggttgtccccgcatgaaaaatcagctccctgctttgattggatatacgcctccagcgcctccgcctggacaggctctttggatgagagcagcatcatgcaaaagagcgcgtctgttccatccgctccggcggccagggcctcccgggcaaagtgggcggtgatctcaggcgagagcgtcggccggcccattccacaaaacggggcgtggatggtattcagggtgtcgtactccgtctcccgatccgcaaagctggtataagtgtacctcaaacgtgcgcctggctggagcttgaagcggcacagctccagatagcgcgtttcggaggaagccccttccgtaaatgcaagctccatctcgcgggtcacaaaagagtccgtttgtacctggtcatgaaacacgatgttgaggacccgggtggtattggttggagtgtaatgaatcagctgcggctcccggatcagataaagctcaccctcgtagcggatcaccccagggttgaccacgatgctgtcctccgtcgttgtcagcgtgcagccgcttacgattccatctgtacagttttggtataaaaggggccccaagtgatagaggtaggcggagagctccaccatcatttcctgcttcaaaatgtgcccactgtgaaattccggaatcttctgtacccacataacaaatcccctttacttcgtcccatcaaagaagttggtgacccagccctctgtctcaaaacggaagaactggtcggggccaagctgaagctgcccttcccggcggagcacaggtaccactgtaaagccccagcggtcttcatccgccaggataaaaaatttcagctcccggtccacaatatcgtccaaatcatcctggcggatctggccgctgtaccgggccacgatctcctcggccttctggtttttgaatttgtccgggtcgcaggagcagttataaatataccgctgccgcccctccagatccttcaggtagagcttcagagtcaggtcagccatattgcgggagataaacccgcggatgttctcccgatccaggctgtggatcagcgtgacttcctgattggtgtgcgtaaaggcggtgaccacataggggaacgccgcctgctcgtgggtgatcttcacatccgcgtagccaaacattttatccttcaggtactcaatggccccgttcaggcagatcagcttcagctcatagtcatgctcctggccctggtcgctgcgggaggacttgattatttttccaggaataaattccttcagggcgtcccggaaaatgtcgatcttgcaggactgccccgtgagacgcaggatgctgtactccggcagctcgttctcctgatagggcccctccatgaactggcgcacgatgccgtaaatatcggctctcaggagaagattcagcgcgtagatgttgatataggcggtgggcacatccttgagcaccttcaagacgccgtcctggaaggccgacagcttccagcggtccaccagcatacattccgtggcggtctcgtggagcggcacgctggaaaccgccatgcgcaggacgttggcgtggctgtaaaagctggtcttgatccgctccgccgtttcaaagaggaaatagaagttgtttttgaccgcgtagtagtccgcccggctcttatgctcgtagtcccggaagcgggtggggatcacccgctccgcctgggcgtacgcctgatccagcccggcgtaaacgctgtcggtgcccagccggtctacggtgcggaacacatcgaggtcaaaggcccggatcagcgtgtccacatcgggcagctcctcgctgctcagctggcgggccatcgccagcttcaaaagctgcatcacccggtaggtcaggttgttgccgccgaaatctgtgttgccgttttcataggccgtcgcaatgtcgatctggtaggccacccggcggtcggtgatccgaaaccggcaggaggagaggtcggtggtgccgccgccgcagtcgatgatcagcgcacggtatgtctcgccatcctgatactgcttctccttgatcagagtggaaatcgtattgtagaggaccgccaccccttcatccagcatattttcgctctccaggcggtagtccggcaggatctcctgaaacagcttgacgaagagcggcttctgcttcaccggcgcggagatatggatggacttgaagctgcacttgaatctctggctggcgcacccgatgacatattccagatagccctggatgatctccttgcgggggacaaagctgcggtgtccctggcggtccaccacctcctccgtccggtccgcgtcccccacccagcgcttcaggtcataaaagacgcaaaagccctcgtcgatatagctcagatggaacaggcggttggcctcatagccgaatttatactgcacatcctgcccgttcacccccaccacggccacggcgctgggcaggatcagggcggccttgtccttgtgctctacatccaggtggggcacatagttgacctggtcccgcttgaggagctgcgcgatcgggtcgccggagagctgttcaaaataggcgctgtccagatagacacccgccgtggtattcgaggagccgaagtcgatggcaagcggcatccggctctccagcagcggccgcacctcaaaattcaggaccgggaccgtgcggaagcgcaggtggtccggcacgatggaggactccccccgatagacgcggtagaggaggtcggactgctggcggtccatgcagtagagggaataattgcggatcgtggactcccggcactccatctccgcggattttgtgatgaacagctttccgggctcgctctggtaggtgcggagattgaaaacagcgcaaatctccccgccgctgaccagaagggcgttggtgtccaccagctcctgcatatacccgatcgtatagcggtcaaaatactccacggagatgccgtgatatacgatgagcttggcgcagccctgcagcgcggtgtccaccaggtccagcttggcggtggcaagcagggactccagacgctccaggccatcctctgacggctcggtaatgaacagccggtccgcacgcccccggaagcgcatgatctcccggatgagcacatccttgtccagcggcgcgtggatgccgttgatgatgcgctcccggtagcagatgtcccgcagctgataggtcgtcatgagctccagctcatcacgcgtatagtaacgcagttccggcttgggccccgcgtttcggttatatgtataggaatacttgctcaaattccccaccgcctctgtccgttctcagtagatttctatttcatcaaataccagggtggcgtccacatcccagacgccgaagtgctttgtccagaaaatccgcacctgatactgcagggggaggaacaggtcctccagcatctgcacgatccggcggtccgcgttggccaggccgagatagagcagaagctgttccgggtgcggcttgagctggtagagcatggcctggggatacagggcggtcagcgcctgacggaataccagcagggaagaccctgtctcatactgcgccaggagcagggaggccacgcctcttttttgttcctccgaaagaagctggagcgcctgtgcgatcgaggcggaaaaaccgccgccctccagctccctcttgagcatctggacgtaaaaatcccgcttgctcagaccggaaagcgtctcctgcgccgcgaggatatggactgcggcatcaaacaggtggcgcagatattcagaatcccccatgttgtgcagcaggtcctgaaagatctcagaaaagcggtacaggctgttgatctccaccacggggccggtcaccgtgtcctcattgaggcagggaaaggactgttcataccagggactgcaatcctcagcctgcgcaaaaaacagctcattgtccgataatccctgcgctctggccctcaataagatttcccaaatataattcataaggcagcccccgcctttaagcatccagcacgccggcgcaatggtactcagggaagagcttctgtgccttggtcaccagaaagctcataatatccatgttcaggaaattccccgggtccgccgcggcaaaatggagcagcatcgtctcctgcgtctcccttttcctcagctcatcggtaataaactgatccatgtcgtaggtttccgcctcggccggccccgctgcgcccagctcgacatcctgaaaggaaacgacgctgtcatacccatagctcaggatgacccgccgcagctcccctctggttttcacgccctgctggtataatgcgcccagattggaggcaaagctctcctccggttggttggccaggagcggatacgcatagcggagcttccggtccgacggatttacctgaatcagcttccagttcaccggccccttttcctggcaggtgatcagcatatcccccgccaccagccgcacattctggagcacacggtccacatcggcaaccagatagctgcatccggggctcagcctgtgggcaaagatccggtgctcataatggacatggtccgcacagggggaggggtacatgctggtgctgacctccacgcgctccagattccaaagcgggatcatcccacggtgcaggaacggctcgtaggcgccgaaatcgaccgtcacggactggacctcgacgccagtatcctgtccagcgccctccgcgtccaccaggtagacatcaaacatcttgtagagataggcggagcataccgtagaccaggggatatggttggcgtgaaatacctgatacaaacgttcgacctgcttcagataccgccggctcctgcggatggaaaaggtggccgggaaagcgccggcctgcgtggtcagggtaccttggtacacggccccctcacgctcaaatttcagcgcttcctgggcgttttggcgcaggaacacccggtcaaccgggactggctcgttctggtccaggcagtcggacagggtgggccggacgtgctccacatcctccgggcagattggggtcagaaagcggtcgctcgcatcgtaaaggtccggctccgtgacgccgatatggatggtgaactcgctttccctcgactggatctcggacaaaatccgctgctccagctttttctgctcatcgcccagatattgaaagagattgaccatcagggtgtcggtgacctgcctatacagcgcccgctctctcagatcctgaatatccaaggaccgtttgtggatatagtcctgcaggtcaaagcccgctccaaagacgctctcatccattgcattccctcgctttatccaacagcctccggctgggatgtttctgacggcgccggctcggtggactcaccggcggcctgctgctttgcttcctccgccgctttcgcggcttcctccgcctcccgggcagcctgctcctcctcgctgatgcccatttcaatcagctccagcttgcgcgtgacctcagataccttgctgtcgttttccagctcggcgtacacatcctttgccagaagatagtatttcttcgcctggacatagttcttatccgcgtattggctctccgcctggcgcatatagccctccgcctccgccgcaaggccggcctgcacggagagcttgctgtccacggcggcgagctttacattgatggcgtcaatctgcgcctgatcctccagctccgtatatttctgaagggccgtggtgtaaaaggcgcgtgcgccctcatagtcccccttggaaaaggcggcgtcgccctcggccaaaacgctggcggcggcagtctgcgcctgcgcggtctcctgggccttttcatcctcctgcgcctgctgctccgactggtctgcgtacatctgctccagcgccgccatagcgtcgtcccgaccggtgtcaaagtagagctgcgccgccagggccttcgcggtcagatactgctcctcggccttgtcgtactgctggccctgcgcaagcgtgtcgcccagggagatcagctcataaacgctcatgtactgactggtctgctccagccggtcatcgatgtagtccaagcccaggttgtcagcgtaccgggtgcggtttctggcgttaaggaaattgcgctgggcgtcgctgtactccccgccggtcagagcgtcatcccccgcgatcacgctctcgatgagcttcatataatttccggcgtcctcctgaatttccttgtcgctcaggccctccgcgagatccagcgccttttggcactcctccttggcccggacgtagttatccgcctggatatactcaatcgtgtcatagaagctctgttccatagagtcgatctttttctgccggttgtggaaatacacggccaaaatgacggcgacaactacaagcacgaggatgatgggaatggcgatcataatggcgcgcttgattttccgcttgcggtttgggtcgttgtaggtcttattgaagaagatcgtcgcaaaggtgtatgcgcccaagtccttaggctgcatagacagcaacaggtcctctaccgcgtccaccgtctcctgcggctcgtccgaggcgtccgcaaacgcgtccttcaaaagcccgtcgtccagatgctcccacacgccccgcgtcatgagcgcggccgcgtctgagtcggacagctttaatttcttggagataaacgggcggaagtccttgtcctgcccgagatagcagtagaggttatggcgctcctggtgctgggtaagcttatccggctccagtttttccgctttcacgaggtccatgctcagggactgatctctggactgagcccggaggaatccgtcccggtacagacggaaacgggtgttgcccgcctgcccataccgcatctttacatagtttgtcaccaccacagtaacagacgccttcaggcgcattttactgtcggcagtcagcagggccttgttggcggagcgaaggtagcggcgcagggcccccttccgcatggaaggcgcctcagtaaaagcggagataatggtatccaccgccagcttggcgctcatcccgtccacctggtcgtctatcccatcggcaatgacatagcaggcgtatttgtccagttccacatatccgaaggagtccgtgtttttcaggtttttatccgcttcggatgtaaatgctgttttgaagaccgaattttgctttctcatgttgtgctcccgtcccagcgcagcaggatcacgctggcattatctctgtcctctgcggagttctggttgaccttttccatgagggcgtaggccatgctctgacaatcctgcccgcctgagaggacatcctcgatctccttccaggggatcagctcataaaggccgtcgctcatcagcacaatgatgtcgcctctctgcagggagatcggccggtcaaaaatctcaatgtccttgaagctgtcctgcccgagatagttataaagccggtggttttccagcatgaccagcgcgtcctcccgggagagcctgccggtccggaacgactgttccgccagcacatccagggtgtggcctgcggataccggcaccaggtcgccgtttctgaacacgcatagcttgacatttcccacaacggcgtaaaaaagccagttttcccgaatcatcgccacgccgacgctggccgcgccgtatccctcatcgccaagctcccgcaggatggcgcggttagccgcatggaaggatttccggaaatagtactggggattgtcaaacgcattataatcccgaaaaagatccaggaacgtctcaaccgccgtccggctggcgatccgtgcgccataggctttccccatcccatccgccaggacggcgactaggcccgtctgtgtagccagcgtgccaacgaagtcctcctgcacctcgcgtccgccgatggtcatggagcttcccacatcggggctgcgtaaccgcctgccgctgccgccgatggacagccggatgagcagcaggaccgctgcggcggcgcacaggaggatcaggattgtttgcggcgtcatatgccttgcccccttcgagtgttactctgtctttccgccccacataaagttctctccgcagaaggggacaaacaggaatttagacttgccgagttcgatttcatcatatttattgagcgtggccggcgcgtacaccgcgttgccgttgagatacacgatcccattggcgtcgccgggcagcagcacggtttcctttttcttggggtcaaatacgataaccgcgtggttgcggcgggagatctcattgtcgcccaggatctgaatatccatgtcgtcggcgcggccaacgaaatttttcccctggacgatctgatagtccttgccctggcgcgggccgtcaatgcagacaatccagccgcagacgggcttgatgtcctcccggaataactcttcctcgatctccacatcggagcgctgcgtctcccgcttttctttcgtgtcggtttccatattgcagtaggggcacacggtaccgtaccgctttttgctgaaaacatgcccattctggcagtggatcagatttgaagtattcgacatgatatagccatctcccttttctcttttttaccggatcatcagccggacaagtcctatatagaggatgtcgccgcgggccagcaggcacgggtgcccaggcgccagcttatatttccgcttgtcacccttctgtacgctcactccattcttggagttcaagtcctccacgtaccagcttccggcagaataattcagcaccgcgtgctccacgtccaccgtgccagcataggtcgagttggcgagattgatattgacctggttttcaccggaatcccggccaatcaccatgcccgtctttccatacagcgtccaggaggacagggcctggtcttcctcgttgagcaatacgatttccgtcaaactgccggccggtgggtgtgccatgccgtccgccggtcggaccggcggctccggaccggcgcggccatcccgcaccatgaggataaggaagatgagcatcagcaggccgccgccgagcgccacaacccagtaataccagtcctcgatgtagaaataccccaccagggcgattgctccgccggtgagagcgagcagaaaatcaaccacacgtttttttgtcatcccgggcactccctcactgtctcagatactcagattacttaaaacccataaaccgctcaaacaagtctgtggtgtccagcggatttttcttttttccagataccttctcctcgtcaacgacttttccggtcgcagggtcaaagccgaaaaattgcgcaaagccgccctgcatttgggaaaagtcgaccgggccgcctgtcggtgtccgcgtccgtgcggacgatgcggactttttctgtggctcgcggccctgcgttgtacgttgcttctcgtcgtattccttccgtttctgcggatcgctcagggtctcgtacgcctcgttgatctccttaaagcgagcttcagcttccttgtctcccgggtgcagatcagggtgatatttttttgcaaggccccggtatgccttctttagttcctccgcagtggcgccgggctgtacgcctaggctccgataatattcattcatgatgcgctcctccttgcacggatgcttatggcccttgtggaagcgtccgtccctttggccggaccggcgcttccgcaaaagtcacatacggcctattatgggaaaagggcgcgcccaaccatgggtcggacgcgcccctctcctcatgcgaaatgccgcgtcacaggaagccttacggcatcaggcagcaggatagccgccttcaatcgtgattccgctgatcttatcctttttctgcttgatggtcagccggaaagtgcccacgccgtccgtgtctccgaaatcctcatcgtagttgaccacgaaagcgttggggaagtaatacttccgctccacaatgccggcctggatgatctccaccgtcaccttccggtagcatgccgaattctcggcgggcaccatggaccacagccccatctggcgggtggagtcaaaggggtcgccgtcggtggccgtgaggatcttgcccgaaatctccagcgtgctgcccacgtccttcgtgcgggcgttggaatccaggggaatgtctgtcttgtagacgaccttctttacgcactccttcgcgacctcaaaagagccctggccctcaatcgttaccttcaaagacatagttacatctcctttccgcgttaagcgctgaattcgccgtcaatggtgaccttggcagtctgatccttcttctgcttgacatgcagatagaaactgccgacaccggtttcgtcgtccagctcctcagcatactccaccacaaacgcgttgggcagggtaatctggcgcacgatctgagaggccgagactacatccaccttgacattccggtagctgtcgggggactcgctggggaccaggctccactgggccaggttaagcgtggaatcctgctcctcgccgcccagggagaacagcagcttgccccaaatcttgatcgaggcgccattgtcggtggcacgggcgttggagtcctgcgggatctcacttccgaactttacgctggtgattgcgcgttcagtgagcttgacggggccggccccgtcgatttcaagtctgaatcccataacttactttacctccagtacattttatttagaagaaacgcggctgatcatgacttccaggttgcgggcgttaccatcaaagtagatggtaaggtcgcagatgcccgttgtctcgtcgatactatagtcaagactgtcgccctcttctaccacagcattcacgcaatccttctttgccagccacaggctcttctggctcttggggttgttggagaagaactgcacgatattgtcctgcttaaaatcgccggtggcatggcgcaggatgcgctcgatataggtcgtcacctgggtcttataggcaggctcataagtagatttgtccggatcatagagcaggttgcgggccttgtagaccgtaatctgcgtgatgttcatcccgtccagcgccgcattctccgaggcaaagatccagccaaaatttttacggttgatttgatctttgatggaattggtgaagccggtgatctccttgggcatggtggtccgggtgcagagggcgtggtttcctgcctccacatcataccgcacgccgggcagctccgagtccacctttagtctgcggtagtggtccttcaggtactccgggcactggcaggccccgcggaaaccggcggcgatataggccgcattgatgtagacaccttcaatccacagccgcataatatcttccttggcctcagagagctgtgcgcttgtactgtcttcggaaatcgtcatgagcttgtccagtgtgacgccggacttgttctttgggataacggtaaagttcggcaggcacgggatggcgaactcactgtagggctttccgacaaggggctcacagcggtcgatgaacttctggattccctcggccgccaccgcattgaaagtggtctcctcccgggtctcgaaggagaagaaggtctccacccggtagtccttgagcacatccagcagggtggacagggtctccaggctgtttacatcctcgttgaccttgtggacattgccggcaaaccgttcccggcgcagcttggcccccgcctggaggctgatggagaggttggggaagatagcgtaccaaatcgtatccttgaagttgttcttgctgttgaccgtgttgaggtaggcgtgcagggtgggcaggctgctgctcttggccagcatttccggcttgagatttgccaccaacagggtggggatcatacctttggtcttgcacttatactggtcaaagaacatcttcacccccagcagcttctccaccaggggcttgaccaccttgatgaacgcatcctttgagtccttgtagaactggagataggagttgtagttggcaacctcggtgggcacgtcgattttggactgggtcgtggagggcagtgggcagaaagtccggaccaccagggactgaacatagtctgagggggattcgttgatggcctgataatcttcctggagggccgcgatcagcccggtgttgacgttatcatccagcgtggccagcgctgtactctcctgctttggcgcctccaataccttcagctcgcccttatcgcccatggtcagcatacccagcgcaatctggtttccgccgccctgctgcccgccggcgcccaaaagcagacgggtcttgatgtcctcaatagccagcggcagcattgccatgacgttattgtaattgttggaggcttcctcaaagagctcattgagcttatcccccacgtccagcttggccggatctccgtcctccagctccgcgtacttcgcatagttgtagcggatttccttacgcacctggcggatgtcgtccataacctttttcggagagatcatgtccagcagattctcaaagccaaaatccacattgagcacaccctgggacttcttgctctccatgagggtaaagagcattttcaaaaagtcgttgctttgatttagcgggatctccgtgagcatattttccgggatgttttccggctttttcagggtgtagcgcaccgactgagtgttggcatcgaaaaaggagtagatgcagggagcgaacttctcctggaactcctcataactccggcactccagatactggttgatctccttgatcttgtcgtcacttaggctgtcgatgcccttcacatccccaatcagggtcagcagatccagcttttccgggttgatctcctccaacagcagggtgcgatttgtctggttgatgatagtcactctaaacactccttacaacagttgtttttatggcggctgagaaaatatccgtgcctattgacaaagtgctttttgaaaaatggggccaatcttttaatttgatattctgaattctcggggaatacggtttgtttccaggaccttgtataagtaaaattcttaaaactgtctttgccaataggtcgagaaaaatctcaggtgcgtgcgtagctcctcaattcatttggcttcacctcgcggtactgaagcgccatctcgctgacctcgtcctcaaaggtaatgtctaccttggaatccagcccgatcagatagctgcgtcccttcatcagaatctcccgggcctgcatgatggtgcagtccgactcatttgacagcaccaggcaccggttggctcccgctttgaagtagatgcggtccgcgccttccagaggctcgctgacattgcagccgtccagaatctcctgcagcgtcagaatttttccgcccggaatacgaaacagattataggtaagcgggggaacgtccctgccggatttggtccgtgtgatgtagagattgaggcggccggtatagctgtatttgctcggggccggagggggcggatctgggatggaccgcggccttttcctccgacgcgaaaccacagcgtagaccgccccaagaatcaaaagcagtacaaaaagggaaaccccgatgatgaccggccggtaatcgggcggctcaggaagagggggagccccttccaaaggaaccaacacggtctgctgcgcgatgatgttcgtatccaggttatcgaatgagatgtatatcgccttggttttatccgaagaaacctcctcctgagggggaagcgccacagagcctgcacgaatcgccccagaccacgcctgcccatccaccgtcccggtcagggagcggccttcaaaaactgagtcggtaagcacctggcgctccggattctcagcgtcatagaaggctacggagatctgtgctgtccggtcatatgataccgcgtcttcatccgccggctcggtatcctcatagacgataccaggcgtcaggatgatatggtattctgtgatcacatccaccttgacctggctgccggccgccccctggaagctgacatgcaccttttccgcactggggtggtccagctccagaagcgtataatgtgtgccggagacctgccgtacactccccgcgctgaaatctgcgttcagattccgaatggggctgtcgctgataaataaaagcctggcgttggttgcgttggcggttgggatcgtgatgtcgagttcttccgtcccgccatcggcatccacaactgccgccgttgtttttttgatgttcagctgctccaaaaggatggagtccaccgcctgctgaatatcctcagccctgggggcgtggtaatttgcgccgccggtctccgccgacgcggaaaaaatcgtgtttgccttattttccatatcagccccaaggccaattacatggatcacaactccggagttctttgcctctgtgaccgcattttcaaactgaccggaggaaaccgcggttgctgcgtcatcctgcattacaatttcgccgtccgaaagcattacaacggttttctcggacgcctctaccgtgtccagaagctccaacgccttcgtaagccccgtgcctgcgttggtatagccggtatagcggacggaatccgccgccttcataatgctgtcccggcttccgctgtccgccatgccttgtgctgcaactatgtccgtgttgtaggccaccacgccgacaacgtaattggaagggaggctgtatatcagctgcgcaatgctgtcgattgcgagacggtttcggtcgttgccgttcatgctgttgctggcatccagcgtaaaaacaacggctttttgaatggagccgctattctgctgcggcggagcggaggaactcactccctctgcggccgctgactggcataatatcaacggcgccaaaacagctgcaagcaacaaggaaacgatgcgcttcatgggttacgccaactcctccctctaatgttctgttgtatggttatattatcccatctattcgacactattttacaatatttatacaaaaaagtcaattaaaatccgatattcttatatcatttcacttagtaaatcatggttttccttttttggctgaaatagagccgcttttggcttgtcttgcgtttgtttttcgcaaaagctgaacaatctctatattattcttgctgaccccttgtttgttttgtggcgaaatgcacaaaaatattttttacatctttctcttaactagtggacaaaatgtgacgatgttgtataataattgtgttttattctaaaataaagcatatagctgttgcgtttccaatccaatttcttttgagaattataattggggcagcttttctttctggaatatgacgtttttactatttttcctacttgccttgttttctttctgctgcatttactcgcacggacacagacaaaaggcggacgccttggtctgtgttttatttttgattgagctgcgcaatactgtatctgctaatcgcaaaacgtaaggaggagccttgtgacatacgatttactgatgctgatgtttgacgacccgcatgcggaggaagttgagcactatttgacctcaaaacaaattaaagtggtgcgggaacatacggtgaagaaagcgatccagtgcattaggtacaattcataccatttcgtcctgctggaccagcgattggaaggtgccgacttcctgatggatattgtctaccagggttattacgggatatgcacttacctgattgccgccggagaatttcggcatgcggaggagcgtgcagccgttttgcgcagcggagcggatgtctgcatctgcgctccagtttctcccgatgagctctacgagcagatcagtgcagtcacccgcagacagcaccggcagatgcggcattcattggccggaccatcgtcgctgccgattctgaaatttacaaacctctcgattgaccccatccgaaatgctgtgatgagttcgggccgcgagatccactgtacgccgaaggaatttgatgtgctgtatctgctggcgacctatgcagggcacatatgttcggcccaatatatctacgaaaacgtatggaaagcccccttcatccattccggcaccagtatccccgactgtatctccgcactccggagacgcttgggcagtaactcaggatatattgaaacggtctacgggcggggataccgcttcattgactttttggaagaaagacgtcgataatttccaatctttctcctaaatttttcaaagtaattccgatgttttccctttataatataatttgacaaaattgattttattttgtcaaatacgagtagacggagggacgacacagtgagagtacagagcgtgcaaggacttcttggattacataacgcagacgccgcagccgtgagtgctgcggcgtttcactattcgacgatattcgacatctctccgaatcggccgcctccattcccgccgctgcatcaagttagggggaaaatcatctgataaagacgggagggaaactgaatccatgctggaaacaaggaaaaaggtagaagcagacttgaaagaatatcccatgctgaaaagaaaagaaaccatactgaaatacgagagccaacatccccagcacgtaacggagcatgaggtgatcggcgcactggcattatctcattccgtgcaggaaatggccggatcagctggttatatatcggacaaaaccatgcggattgcccttcaatttcaggatgaaaccgaacgcctcaaccgggatgcatcttttgaaatcgcccaagaactgttcaatgtcaggcggaaaatgaagaaattggagttctatgtttcccagcttccgcccaagcaggccgaagtgatccgaaagcattattttgaggagtatagctggccggcgctgcagaaggaacttcatgtctcctcccgtaccttgatcaaccgcagggacgagggcctcaatgagctggcaaccatgtaccagtacatggaacaggtaacgcagtcctcgaaaaaaacgccagaacaaaacgggtagatttccacatggactcgtcctgtcagacggcgcttgcataactgcaagagaaagagcctgctgtgagccgtgaaaatatcgggtcacagcagcttttttgttgtaaaatagttcccgcctgagcatgaaatattttacaatcggccctttgcgctttttcctgcggcgtctccacaccgctgtcagcgaatccaccaggggcgccctgctgtttattcggcaggtcagaggggagctgtactcatgaagatcgtatcctggaacgtaaacggcctcgccgcctgcaagcgaaagggctttttgcgcgtccttgccagatcaggcgcagacattttctgctgccaggagatcaagacccggtgccccctctccaccccagggtacctccagttctggaatccggccaaacgcccaggctactccggaacgctgacacttgcccgtaaggagccgctttccgttcggtatggcatggggattcgggaatttgacgtggagggccgcctaatcactctggaatatgacggcttctatgccctgaatgtctatgtcccaaactcccagagcggcctggctcgcctggagtaccggactgcctgggatgccgccctgcgggagttcctgctcacactggacaagccggtgatcctgtgcggcgacttcaatgtggcgagggagcatatcgacatctatccggaaaacttacgcaacgagccggagccgccgggctttcagtccctggaacgggaggggatggaacggctgctggccctggggctgacggacgtgttccgggcctggcacccccaggtggagggggcctatacctggtggtccatgcgtctgaacaagcggctggaaaaccggggctggcggctggactacttcctgatctccgaggcgctgctgcccatgatgcagagcgtcgcccaccacacggacatccttggctccgaccactgccctatctccctgacgctgcggccggcctctccccgcaaagagctgtccgatgaggatatggtcgccatgtggcgggggctggactggacccagctggaggacgagctgctggagtaccagcggagcctggcccgggtggcttttgccggccactggggccatgtggccgagctgcagaagaagcttgtgcggtcgctggccgccaaggcgctggccgtgcgccatgtggtgcagaatgactcagagccggggatagacggggtgcggtggcagacggacggggagaaaatgcgcgccgccctctccctgacctccaagggctaccacgccaggccctatcggcgattcctgctgcaagatggtgacaaggagcggcggatcaatgtgcccaccgcttacgacaaggcaatgcaggccctctacgccttttccctggacccggtggcggagtccaccgccgataagaagtcctttgccttcagaaaggggcgctccatctatgacgcccacgcctgcctctgccgcgctttggaaggaacgggagccccggaatggatcgtgcgtgctgatgttcgggcctgctacgactccctgagccaggagtggctgctggcgcacatccccatggaccggaaggtgctccgggagttcctgaaggccggcgtggccttcggcggtgagctgttccccacggaggtaggtatctcccagggggcctcgctctctcctatcctggggaacatggcgctggatgggctccaggcgtatctctatgagcagctttaccccaacaggtccccggactatggcggcggcgatttgacgcggtttgccgacgacatgattatcaccgcccgcagccgggcgcaggcagagctcatcctggagctcctggagcagtttctggcggcccgcggtctaaaactgaactgggacaagacctacatcagcaaagtgagcatgggctttgaatttctctcccggtggtatcggcgagaggacagcgtcctggtggtgcggccctcggatcaggcggtcaaaagatttgagaacagcctggaatcctttatcctgggccacaagggctcccagcagaccctgatcgaacggctcaaccggaagctgaacggctggggcagctaccaccgggtcaccgacgcctttgacgccttccggcggatcgacagctgcgtacaggcgcttctaattaagaagatgcgccagctccaccccaagcggaagtggaagacgatccagaatatgtattggtatgagcaggacgggcaccatatctttgccctgcgggacaacaaatctgtgcgggtggcccgccttgccgaactggagatcacggagcataagcccatccggctctccttccatccgtacctggatcagggctactacctctggctccagcggcggagggacgatcagaaggtcagcggcgccaagcggcggggcatctggcgcaggcaggccgggcgctgccattactgcggccggcccatgctgccggaccaggagatccggctggtggagctggttctgggccgggggcgcaccgtctccaacctggcctatatccaccagagctgtgcctatgatgtggtcatcgagggcaaggagggggattcttccggcctggatgtactcaccctgctggatggggtcacggagcctgtccgcgggctggaggacccctactgggacctgcgggaggtcttccgcctgtgcaggcagccgtctgtgacactgactttccaagaaattgagcggatcatcggctttgaactggactgggaggcccgttacttccaggcgttctggtttgacgaggccccggcctatgtgggcagccagtgggagaaagagttcccatttcacgccgtagagccctcccggcaggctgcggagtacgtgatctccgacgcctggcgcagccagggctaccgcatccagcggctggacctgacccacgggaaggtggtgttccaccgagaggtctacgggactgtgggcctgaccatcccgccggtgctcctgcaaggccgcatcccagaaaatgcagcccatgaggccacgacttttttcgcttatctgattaaaaagtatggattatagaatagattctcttggcgtaggcgtatgcgctaaaatgcggaatatgtatattgacaatgtaaataaaaagatatacaatgaatataatagagcagaaaaggagttgttattatggctaacacaaatatcaatatccgtatggacacggatttgaaaaagcagtttgaagcgttctgtgcagacatgggaatgactatgacaacggcctttaacatttttgcaaggaaggctgtccgggagtatagaataccctttgaaatcagcggtgatgtgccgaacgctgaaaccgtcgaagcaatccaagaggtaaagagaatgaaagccaatccgagcctcggcaagacctattccgatgtcgatcagatgatagaggagctgcttgccgatgtataacataagaccgaccacaaaatttcagcgggatttgaagcgcgtaaaaaggcgtggctttgatatttcgctgttgactgacattattaaaaagctagcggcgggagagccactgccagagaagaatagggatcaccagatgtccggggattatgcagggtgtcgtgagtgccacattaccccggattggctcctcatttatgaagtggacgggaacgagctgattttatatctcacccggacgggatcgcatagcgacttattttagggggaggaggaaaggtttatgagctgggataaagagaggattgcgcagatacagcttcccgatccggcagacagagagccgcacccccgtctgctcctggagggggatggcgtacacgccgggatttgaggatgtatgtcctattggcctgtttgtgcaggtatgaaatggcctagtattcttctggacggattcagggcttgcgaggaccagaactaaacgggaaacggcctcccttgaaagggggccgtttctcttgcattttgaatttctacattgatataaaaggccctgtccccttgctggtaatctacatcttcatggcttccatgatgctcagtgaatggaatatttctttgatatgctatggaggaggaaactacgataacagaaaccgcaggaacatcgtgtcctgataccaggcaagaatgttctgtccgaacatgattcggtatattctccgcacacaacaaaataaactgataccggtgaagctctggaggaatcatgcgagtctctaggcttcagtttaagaattgtgtatttgcacatatattattaaaagactcttaaaaatattgacattttatgcaactccgtatatcatattactgtaataactttacagtccgtcttattatacgaggaggaattttgatgaaaaagttatttacactgctactttcgttggcgatgctcgtgtcacttgctgttcctgcttttgctacagaactagagggggcttatactcaagaggaaatcaatgctatcaacgaggtcaatattgcaaagtatgctaaaagttttgttgatgcggtcagtgatgatccagaccttgaatcaggggatgttctcactatctatagtgagaatgacaaaatctccggatattgtatagacattgttaaagacagtttgccaaatggctatgtggttgttaagttttcgaataatgaacctgttgtatcggaattttcgctgggagctggcgttcaaaatccgtatgaggtgatcatggagagggataatattggaacggaagatgcgattttttatagtattggttccaatgattatcaagttcttgatttgaagcatgaagtaatggcttccagtgatactacagagcttgtctccgaaaaagaatttatgacatataaagaggatgcgaaggagataaaacaggctgaattacaaacgattactgattcagatgacggacttaattattcggatttagatggatggtcagttgtatcggacaactacgaaggaaccgtgaaaaatggtatggagcatacaattactggggcagacgatatagacttgtggtactgtggggatcatgtagaaaataataataggacgtatgcatgctcggtcgttgcactctgcaatttggcaaaatactatcgtgaaaatggttatgataagataagcaggtcgtttactacgttgtacgatactatgtgggattatgctgggacgaatgacgaaggaactacgagtaatggtagagaggctccagcagctcagcgatatttgaatgagctagggtataaatgtacttatagcagctatttatttgataattatggagactttacaaaggatttagataaaaacaagccttgcattttttcctatggagctaaatttggtaataaaaagggtggacatgctgtttttgctgtaggttacgtggaaacgactgaataccagtatctgcaaattgctgatggatggaatgactatctaagatatattaactttaacgggtatgactatactagaacggatggttggtcatttagtgtttcaaaatgatgattacagtaaagaagcttttcctgtgtggtggagtttttcttattgtagttataattcttatgatgataatgaccaaaggccaaccgtcaggatggttgagactaaatgaagttgaggcgtacgaaaacatactggatagcaaaatttctgagattacattacggaaaactgtagattcagcaaactgggttgttttctcggacgacgatttgattaaaatatggataggttgcctgaaagacatggaagttagacgggcaaaaaacttcgccccatatcgttatgaagagaatggtggaggtggttccgtagttgaaatagaaacggaaacagaaaaatatagtttagtattccgtaatatgtctggcactactcaactcgaaattggtggtattctgtatgatattcgtgaaccagaaaatattccatttgaagagacatacgatatggccgttgaacggcatggggtaaggactccatgggattgattagtaaggtacaatatacagtatatttagagggattggagggagagacggctgggagccgaggaaaataaagtggccgacagttccgccaatctcccgcgagagcgcgcaaaagcactttcatactgccagccccaacggggcggcggtgtgaaagtgcttttatttcctttctccccggagaaaggaacaaagaggggttgcccccttgcgggggctatggcaagatgggacctgatccatccaataccctatcccggaaaacgaacgcgtccagaaatttaaggccaagtttgctttataaaggataaccgccaccttatggcagcggctatcctttcaatcttttacttatttccctggtctatcttgacaagggcagatcaatccgtctcccggcttttgcagtaaatgctggtgtgcctcggggtttctctgggagactccatacagcatattatttcttgagtacctgatgagtccggtggatgccggacttgtacttcaagcggtttatgatttcggcgtgtctggaatgattacaaaaccgactccttcggtaagcaggaccgtcccgccgcccttggggtcgtaatccagcattgttttacgcccaatccactccgaggggaagtcccctttccggaattcgtacaattcctgtgtccacatacccttgtagcactcaggtatgctgttccattctgactgtgtgatttgtttcaagctgcgccccctcatgcgatccggctggacaccagacgctctgcgatctgctctctggtcagttcactggtgcggatgatctcgtcacaaaaagcggcaaggctgaattcaaacgcgccgctatcctggtccagcagtacgccagtaatgtgaaagccgcgctttgcctgttcctgagacagccgttcccggaatttcgaggggagctcacatgcgccgtccgtgataaagaccatatccgcattctcaaatccactttcctccatcaagcgcagggcctcctggagcggagtttcgtaattcgtacctccgctcagaaacagctctgcggcgcgcaggacatcttcctgatcgtattgccgcgggatgaaaagatccgtcttaaaatgccccttgcctgaaaagtggatcatggcgaaacggcgttggtcccgcatggcaatatctaagagagccagcgccaccgctttacaccacggggccgcctcctctgcggagtccgactcatccagcatacaaattatatctccgctgcctttgcgtatggcctcccggcgcttgtactgcttgaggccctttttctggagcttccgcagaaacaagggtgtggtttccggaagggccaggagaacaaattctgaagccagcgcacggctcagatccgcgccaagctccagggtgtacttctctccgcgaccgtaagcatagccgtttttccgtttcccttccatcagctccttcagacgccctaaatacctggcgaccttcatcagcgtatcgttctgctggacgcgatgcaccaattctgtatcggcggctatgcttttgggatcgctgttatccggccccgtgccccaggacatcaatgtgagctgtacgtctatggccgtctgcgcggccgcctcggaagcctgttttacaagcagggtaagctcgccgccgtgcttctgcaggttttcctggactatgcggcccacggcctccacctgattgctctggctttgcgcggtgttcgccgccttgatgagctgcgtttccaatgccggagtggcgccagactgctccatctgctctatgagcttttgcaggcgctccatactttggtcccgtttttcttccagatgttccagcgtttccaatgcgtttttctgcccgcctgcctgctccatcaggctgtccagattgtccgccacctgagagataaactctcccgcggcctcataagccgggatctgccgcccctcacaggctgcctttatggtgggataggagtccccgtccatcagctctttcaggatagggacattaaagcgccgcgagggcgcggacagggattcctcttcacgttttctcacgcggagcgagtagaagctctggtaaatgtcccggctgagcgcggagaaggtggagagcttttccgtgcagctctgctccagcgcaatcagctcgtcatcgtctttgtggaggccctgataaatcatgtcctccagtttggtggactgtaatacccggtcttggcgggctgctttgtcccgccgcagggcgtttgccgccgccacaatgggagaggccaatacatcggccaaactgcggaaatatttgcgcatagatgcgcctccttcttgactgcgtgtagtgcacatgagcgcgcacccgctgaaatggtccatttatttgtgacgaagcacagccgtttgccgccgccggtcttgaagagtaccgccaggccggacgactcagcgtttttcctggccgggagccaaaatcagctcataggactgggcctgaccggggaaaagggcctgttcgtattcgatatagccccacgcttcacggccaatctccccgcagaacacccgggcgtcaaaattacggatctccacaaccggatttcccgcaggcttcgggtaactgcctggcatgatggggcgctgcgtactgtaataccgcattgtgatcgcacttccttttcttatttattccatgcgtaaaagctttccaacggccagcttgcagatttcttcatggtgccgtctgtatttctctccgctttgatccacacggaggtcacaggccacttcaaccccagaaggcaggcggctcaggctgtatgagccgatagtctcggcctccagccaacgaagcagctcatggccgctcatggcctcaaaatagcccaggctgtcctccacagggaaggcgctgtaaatattgatccctgtataagcctccgcagcccggaacagatggaagccgtccggatccagttcgggcgacaaaagcgtgtaaacggcctcgtagtcagccgatgccagcacggccagcgccctgcgcaaagccaccagctctacatctgccgaatgaagctccgcttcccgctgctgtaagtggatcgcctgcctgcggttttcttcctgctctgcgctgaggcggcgctgaagttcctctgcctccgcccacgcagcttccgcctcatcctgaagcgaaagcgccttcggcggcctgtttcggcgcaggcggcgggcgcgaaatggccgccggatcaatttaagcagtctcatatggaagctccggcgcctttcaagaagctgtgttggccgcgccaatcgctttcagcgcctggccaaacgtgctctccagccaatgggggctttgcccctgcggagaggatttcgttcgcgttttgattcatcattaacgctcctttgcccattttatttttcatccaagctggcctttcgaggtggactggcgtcccctggatcgccggaatttacccgttccacgcagttcaggtatggccggcaggctgttggaggaacacaggaacgccggaaatggtataactcaggtacaggctttccacccccgcgtcctttgcctcgtaggaaaaacgatagccgtcgatcaggcgctccacatgggagagcacgaccgggatctcataggtgtccagatcctcccgcattttacgcagcacaagaccatatcgttggaaagagccagtgtctgggcgttgcagccgcagtcgctgtcgtagaagcaggtgagggaaagaagcctgccgtcctccgccggcatgcgctccggaagcggctccagcatgctgggcgccaggatcacacagtccagtcccaggtcctccagctgctttgggtatctaaaccgtgcagaaaaccgctcctggatgtcctcgaccatcgccctagattcaggcggctgaaaggcgcagcagatgtcgggggcgccctgttccgcacactggtccggcccggtgcggatctccgttaccgtgccgaaaaggccctcatagtcgcaggcgtgattggcgaatacctctccgccgacggtaaagactttgccgctgtcaagcactgtatcgccttttttctggtataacatggctcatatctcctcgtacatggaatgtggatcagaacgggcggggaattgctccccgcccgaacatagcttaaaaacctcctgggtattcgtccggcccagcgccaggtacagggccttcataagccccataaccatcagccggggggaattgcccctgctggtttgccggaggataaccgccataggctgggcacccaccatagctgccatcctgtgccggatatccgccgtagtccccaccggcggcggggtatcccgtctggccgttctggctgttctggtttggccggctgtctccgaagtagacattgtcggcaaccacctctgtggcaaatcgcttattgccgtctttgtcctcccatggacggatctggagccgcccgtcaaccgcgatcatgcgccccttattgaagtagttggccacaaactcagccgtagagcgccacgccacaatgtcaataaaatccgtttccttctgatccccctttttatagtcgcgatccaccgcaatgcggaaggagcagacggagagattgctggctgtgcttcgcagctcgggatctgcgaccagtcggcccatgagtgtgactctgtttaacatatccgatacctccaaaaaatcatattggggttttgcctgtgcgacatcgaaaatgccgatcggcttaccagccggcgtcttcctgatttgcgaggctgcgcagcatagtgcgtacctgcatcagcgcaaatccaagcaaattaaggcccctccagtttcccggatcttgaatgccgggctggccttttgacatgccgatcccccatatcctgtcatagagactggcctccgccaaaacacggtcgccagtctgcaaaaggaaggacttcaaagggggattttgcaaaaacttttgaaaatttccgcacagtacgatctgttcacggacctggcgccagctctcctcctgaaagcctgataccatgcgtcccaaggctttgcaatccctgggggtgcaggcgcccaggattctggcgtgggtgcggtaatccccaaaatacgcggccttctgagccatcatgtactgctccatagactggtacaagatcccctctgcttcaaaaatgcagggataccattgactcaggcagctttcggttgtgctcccatcagaagggagctgatgtccataaaagaagagaaaatccacggtttctccgccctgatgcatccggcggagcgaatctgcggtgtaaaacataaacgattcctcctggcgccccgggtttgcccggggcgcatataccgtttttctccgagcgcgatatatgctccccgcactttcgtccgctcaaagtccgcactcagctctggacaggctgctgcggcccgtccagaatggatgtctgcggaacggcgggctcctccttcatctgatccagatgctttataatggcctcatggtcaaatgaccggatgatgtccgcatctttgcagaaacaaaggaaatgacggatcatacgatatgccgcatggtattcgctctcgttcaccggctgatactggcgtaaggcatccagacagtcgagcaaatcacggcatgtgttttcaaagcggcaatcacccatattcgacatagcaaattctcctcaagccgcacggggggcatccccaatatagacttccaggatgcttcttttggcgccctccatttccagagcgaccactttataggggataccgcagatggcggagatttcccggtcagagtagccaatgtcgcggagctccgcgatcctttgctgcagcggggtgagtgtgctggtgtactcctcgaactggatcacattatccacactctccgcgacgctgtcccgcaggtcgtccgcatcttcatcgtcattcagaagctgcacaatgcgcccgcaccgcttgccgcgaagccagtattcacgtgaatgatgcacgtcacagctcatggcgcgaaacgcgatcgttgaaaactggtatgctctcagttccgggcgggccaaatacttccgtacggcgcgcagatagccaaagaccgctatatcatagaattcatcaaaatcaagcctggcctttttcaagtaagagaggagcaggtgatggtgttccgcggcgaaggcggattcttcagcagtcagcggcgtattataattcaacatggtaaaaactcctttgtccattttttgatctgccggggtatgcggaccggcaagggccggcccgcatgctccgattttttggggggagggcttgggcggatgtccagcccaaacacattcccatgccctctgttttgttccgctggggatcagcttgctttcagaagataaagttccttcagaggcacgtaggagaacactccggatactccgtcctctgaaaaagccttcttgttaaaggcttccagatcctccatacaggcgtctactttctgtctcccaatgtcatcctgaatttctgccctcatcgcagacagcttttcgtacagcataaggtactcttccctcagctttccgatgcggcgggctggcgctgctgcgccggagtcgtcttcaaactcctggtagctctcctgcgctgcggcaaggataccgtccagccggtttttgaacgggtcgctgcacatctgcaccagggcagattggatgatggcacgctcctccggcgcggtccagaggtagtggcgaaggatgatcagatcagccggggccacggtatcccggccctccagccacgctttcgcttgcgcaacaggagcgtagttgaaatattttcgatctgagatatgtatccccttttcacgcaaagcgcagagcacatcgtccatcagctcatttacgctgtccgggatatggacctggcgtacatcgtcctgcatagcttccaattcttccaaggtgataggagccgcaggggcctgcgccagatggggggccgcctgtttctgctttagtatcttcaggcgtgcggcccggtcttccacatattccgtgaccaccttcagctcaaaacggtcatagagcggcttgagtatcttctcctccggattcgtaaagttggggatctcattggaagccgagaagaaggaaatggttggaatgtggatggttttgccctcgttggtataacgccgttcattcagggcggtcaaaagggcgttgaggatgccatcggacgatttaaaaatttcgtcgagaaaaacgatgtgactgtccgggagcttgcctttcgtaatgatgcgcggctccccgccatgcagttcggagagcgctttccggtaccgttccagctctgtggtcgccagttccagctgctgtccgaacgacgcatcgccgcggcggtagttcagcaccagggtctccaaatcgcggcgcatctcctggtaaagagcatcctcctccaggatctcctccggcactccgccggggatcaagctggagaggtccaggcgcccaaacagagcctcctcatcggcctgtttggacatcaggcgctcaaactgcctagccccggtgagcccatcgcggaacaagttgatgacagcgcttttggcttgcccggtgtcgcccaggacaaagacattttttcgtgtcagcagcgcaatggcaatcacctcgatcagctcatcgcgttctgccacctgcgtctggacctcccgcatgcgggcacacattttgcctctcagtgcttgatccatcgtgtcattcctccgttcagattttatcgaagccagacccggagcctgccgggggtagccgacagcatagcgtccgaaatcgggactcccgcgttaagtagggctcgaaggccggcatcttccatgatgaagctgccggaacggtaagaggccgggtggtgtgagggccttgcccactccggcatttgtgtgtcgatatacgtctgggcatcttcataggtgcggaatttcctggcatgggcggcggtgtcgtagccaaccgcgtccggaacgccgcacttttctccgtgctccgcatagtagcacattccgcccgacatatgattgcattgaatcaggtaaagatcatgctccatcggcggccctcctgcaaagcgtaaggatcttcccagcgggaaggcgtttgaatccttcctgccggctcacagggagtgctgcgcacagctggcataccagattggctgtgacagcatctaaaaagccccactctccggacgggcctgtgtagggcggcttcaaatcatactgccctgttgctccgcgccttgggcggatcagctgcaggccatccctgcgtacagtttcacagcactcaaaaaaggtcatggtaaaaaccccatttcttcccgtatttgagaaaatgcgttttctctatttgggctttggcttccggagtaccttccatcctggaacaaatactgatgcagggtctcacgcccctcaaagaaaggagagcccccgtcccgcacaagtgtggccagccggaaggcaagacttggataatcatgggacacaacccgaaaaaagttcttcggcagcggctccggcacaaaaaagcggtattgtcttcgcccaagcgcccgtctggcctgcatatccagcaggtcatcgctggattcccagtactctttgcaccacaggcgtcccgcggcatcaaagccgcggcgctgaacagcctccggaactggaaacagcgcatggaatgaataatgggcggtatgggaactgggccggtcagaccattgcgggccatatccgctgcgaaagattttgtcaaatgtatttagggatacggtttctcctgtgacgaggagcagacattcttcataggtgtcacccattgcggacctccttgatgttccgatgggcgcatgacgcactatggcgtatgcagcacccatcttactttatcgccggagggataccgtctggtactgcgcgggcgcgagggggcgttccagcctccggatgggctgtgaacgacctcgtccacctggaatccgaccgcccgcaggctacttccgctctcctccggcagggtataggtcagaaagcgggtgtagcccatctcccggccgatccggatcgtgcgggcatagaggttgctgcacacgtccgcatagcgtgggtcggcgcagtagcggttgatctccagcgtcacgccatccatctgacagcgggccttgggtatgctggcaatcgccacgcccaccggctccacctctcccggcgcccggaggcagagagagaatttgtggaacttcggtccggcgttgtggcggtggtgggcttccacataggcgctggcctcctgaagtgtgatggggcacgcctccagcctgattgtcaggctggaggtgatcccatccacatggtatagccggccgtagccgtcctccgtttccgcaagcgcatagtcgccatacttgctgcgtacggaaagcgtctgcttccgccgcttgtccttgagacgcatgggcgccgcaggggctgtgaacagcacagcttccagcggcgccgaaaactccggcatggcccgcagcacgggatttgccgccgccgtctccggactcgaacagtgaaaggcccgaagatggtagggcattctccagttgaatgcgtccatcacgcagtcaaaggccgcctcgctcagcagtccgggacaccggcagctctgcgggcccaaatggacgatgaacgtatgaagtcccgcccatggcgttgtgtgtggctcagtgtacatttccttgaccttcctatccctccgtcatagttccaggtgaaggctgaatgttcgtaccttgctgacatcctcccggtgctcaaaccgggagcgccggtgccggcgggccagctcgttataggcgtccagcagatcaaaatggctctgctccgcatgtgcatccggcccgggactctccgtttcatagatatagtgggagaccctgacctccaccgattcttccagcagctccgccgctttacgatagcgcgcatcgcgagtgatcagctcccagatgtcatattcgtccggatgcccgctttcccagtaggtcaggacttctccgccgggggcggcaacgaggaccgtggaaaaggacagcttcatactgccgcctccttccgggacagcagctcctccaaatattcagccatctgacgctgattttggaagacccgcctggtatggctctcatgataagcccggctgtcgatgggcagcgcggagtttgcggttgtcaccgacagagtgccgaattcatgcgtgacccacatcctcagatgaagcctggggacttcggccacaagccagagcggacgctggctggcaatccaattgtcggaactattggcgcgccagccgctttgatcaaggtcgattctggcgccgccagtttgcagcgcgtcatagattttttggtacttcatacagccacctcaaatatttttggaatccagatcccgcagaaggttttcctgtgcgatccgtctggcttcccggtgcattcgggatactttttcgtcatacgctgcgacgttttctccatacgcgtcccagatggcccgggcggccagctccagcatctcaacgacacggtctttgtaggggccggccttttggacagactgcgcccgcagctcccaaagctccatcaggcggtcatattctgtttccgtaatcatttcatagccgtaggcattctgaatatccacctgggagtcatactcctccagggggcggaatatatcttctgagttggctttggccttgctgcgggtacgcagtttggctttccggtagcgcgaaacagcatcctgaatgctgtcctgtgccgtctgaatatcctttttcagcgcttcaatcgctctgcgctcgaccttggcttccggcgtctcgtttcgtgcccaaaggtcaaggatttcatccgcggttgtcaggctcatgctgtcccttctttctgtccgccgcaagcctgcattctgcgaagctcggcctctaattcgcgctttggtgtataacggtgcaggttttcgttgacataccttgtcgtgtgatacatcagtatgccgcacaactgccccatcaggcggccggcatcattgtcctgacgcagtgttttgaaggtgccgatcgtgcagcggttggtaccagaatcatcaaagttgccttcaatggctaggtcaacaaaaataccctcgcatccgtagctgatattagcgattgcggaaaactgatagttggtcagatagctgtccagatccgaagacagcggctcctgcgcgtttggaaggtagtagtccaaaatgggctcaatttcccgcaggtcgccgcaggctctggcccgttccagcacagcgcgcagcagtgtgctttttcgatcccgccgcggggcggtatagggctcctcggcgtggcaccggctgatccaatcctcaaccacgccctggtcttccgcatggaacagcttgaggaactgagcgttcttcgcgccaagggtgaggtcgtcctgttccatgtaccaataggcacgcattgatagagacgtgcggtacgcaccgccgtcgaaacgttgatcaaacggacggcaggactccatctggtggtagatctgctccaaaagggcatccacggtaagctcgcctgggatattaaactttttcccgagttgtccgccgcagtgcaggcacacgccggtcagatagagggccctggccacttccggctgatccagacaggtatattccagattccagcccgcggggataaagttttcctcatagtgctctttacttttttgtgtgtctcttgtccgtgcgccaacgcaggcgcagatttttttctcattcatgttcatgctccttcagcagtccgtctttccgcaaaagagcttcaaccgcccgaggtgatttgaatttttccaggttgtagtttctcacccagttttgtggaacgggcgtattgaaatccaggctgcggaaacaggtcttttcaaataccttgattttgcggccattcgtaaaaatggcgattttgcagggggtgtcatacattccggggataaccgcgttcaggatcttatcaagcctcatacgcggctggccccctgaatcactgtgctgtctgctcattggctggtcttacgctccatgccgaacgccttcgccgggaaaacggtcgcttgattatagacatagaaaaaatagggggctaatccgttgtcgatctcaatgagctccccgttctgtaccgggacgccgttcaggatctcatccaccgtctgctcctgggccgcggtatagaattgctccgcggtcaagccaagggagatctcctgcctcacctggtagcggtggctcatggggaaataccagcccacctttgccggatctatggacagccactcgtcgaaagccagcctctcctgaagcgcatcccggaagccgtaaatccggcatacaggtgaagtcaagcggagcgggcaccataccggcggtttgagcttggaatcctttttcaaaaagcgcttgccctttttcccttttttcatgcaatagtgcgtctcgttgagcaatgagccaacggtcttgaagtgcgggcagctataacggcagcttggctcagggaatgaaatcttttttgacattcagctacactccttttctgatttgcggcgcgctactgcgcatcctgggtttcagtccgctccagccagccctgcgccagctcctgatcctccttgtggaacaggctcaagaataccgtgcggaagtcccgctcatcttctgcagagcgaaaaccttctaccatccacagatggaggcaccagtggtagatagcggccagcaggcgttccggcgcttcatgctccggaagttccactccatagcaaaggcgctgtccgcattggcggcagataccagtcatgcacagccgccgccctttttccggctccaggctgtgataggcaagctcaaagtgatcaagctgcaaattctgacgcatatgcctcagaagctggtcggtagtcatattctttgagcagatgcacaaagggcgggaggaattgcaagattcctgcatatgattgctcctttctgcggcggagcttacgccgctttcctcttctttggctgtgtcagacacaagcggatgacccgttcacactcatccatctccatcagtccgatgtgtgcgtcctgttccggaatattcaggctgcgcgccagccagcggtaagccgcgctccggctccacccctgctttttccagaactgatcgaaaatgcggtgtgtctcctgacgcttcaggcggagaacggtgttggccacctttcccatcggtcggccatccggatagcacccgacataggcgttgcagttgacgcataagtagatcggctcacgccccttgggatagagggcgcgggtcgtggacttgatgatcttcccaccgcaatagcggcagatgcttggaatttccatggaagatgcttccctccattctcacgcagcctttccacctgcggcttgctttggcgcacgcatcggggactgaaggtagcgtgtctcgcctggacggatcacaagcaggccgttttgatcaaattccaatgtgatccgtccgcgcagctgcttgagataccgcattagctgtttgaaatcgtaataaaagggatagggcgacgggctcaggatcagggccttgacgggcacgctggccctcccgtcggaggtttccgcactgacaaccatttcgtgctctccgaacatgatctctccgcggccggaggaatccttatcagcagacgccagggatgtaaccgcgtctactgcggcgtatagttcagcagcttctatcgaggcgctgtacgcgccctgaatacggtccagaagcccatctgtgtccgggtagctgccgtcaatcaggtgcgtacagaacatcgttgtgccattccagaaggccaggccctcgcgggtcaggcccatttggtaaacatcgctgtccagggagatggctgccaaaatggacagggagcgggctgggactaaaatgcaggtttccgaggccgcgacacaatttttatccccggctgcctccgcaatgcaaaagccgttgctgctcgtggccttcaggccgtatggccctactttcaaacgcacagtcttaagaatattttgttggtcgccggccgcggccgcgaacaaggtctggcgggccagggagcatatcccgctgaccgggatggtgtcttccagaaaggggacctccggaagcgggtacttagcggcgtctaagatgttgagcctgtactccgcatagccggagccgatgtggatgataccagggcctaccgtagaaaaggaaacctgatctcccggaagccgcttcagaatgtccggcagcagatctgccggaatgacagcgcttccgctctcctccaccgcagcgggcatggaggcacggatggaaacctcctgattggttgccgtcatggtcagcatagccagccgtgcgtctgcttccatgtggatacctttcagttccgggatagtcgtgatcctaggcaccgctttggatgcttgagcggccaggaccagcgccgaatcacggtttgcatgtacgcgcatgatgtttaccttcctttctatgcaatttggaataggagaagctgatcttcatcgacttccccttttttccgcttgtgctcagctttcgccgtctcaaaaaagacgggggaatcctgcggaagaactgcggcctgtggaaccgtcctctcctccgtaccaaaggtgaactccaatatggatggagaactgcgccccaacacagcgctgtccgttttccgcacctcgtctgaaaaaatggaccatgctgcctcctgaggtttcagcatagccatccgcttgaacgtagccgcaaggtcttccacgctgtctttaatgcccatcatcagctcacgggccatcagagtcgtcatgtcctcgcattctgacatggcggacaggccctcttcgctgaaggagccttcgatcatgccggcagcggccagcttggaggccatcagcttgattgccttatgctgcatcgtgcctgcatgatagagcatataaacctctacccggggtgcagactggttgatccgccagctgcgcaggctggcttgacgcagcgtaaaaagtttgtagcccgtatcatagaaaatcagcgttgtgaaagcattcaggtccaagccagtttccacaagggagggatttccgatcagcacctgaaggccgtggtcaaggtaatcctgcacccagtcctcccgagcctccggtttcacttttgcctccaggatcgcggcgttccagccgcgctctgtcacaagcttcaggagccgctttggagtatccagacgggtccagtttgtataaatgagcaccttcccgccggccgcgattttttcctccgcgattttcagcaccatttgatccttcggcatgatggcgccaggcggcatcgtgtccttgggtttgacaatatcgtagccatcgaaagggtgcttgattgcgggctggccatagggttggtctggatgagcggtcagaagattcatatatgaggacaggatttttttacatgccttcttatcgcttttcatcacatgcttcagcgtatcttcaagccgcttgtattccttccgcacttccggcgccatctcaatcggcactgggatctcctcatactcaggcaggacctttcccatgtctgtcagattcaaaaatgcggtacagtccagcagaaagcgtgtatagaccagcggcgaaacacccggcttcagacggctgccctttttactccgtacagtacgccggtttgagttgtaggcgccttcccgctcttcgtaaatattctgtatcacaccgtattctgtgtcgaattttctgctgtccctatagggttttccatcctggcacatgcggcgcggggcaatccggtagaggagatagaacagtccggagctatacccgttgacaagggtggcggtcataccgaccaccttctttgccgcgctcaagagctcctgcatagcgtccccttgtccggaattgttgttatactggtgcagttcatctgcgatcagtgcaaaaatttttcctttgtaggcgcgcttgatgtagctgctgagcgggaacgtccgataggctccccggatcgggaacggtatgtcaggacagtttgccagcttagtcatccgatcccgtatggcttcgttcggaatatcctcccggtattcgttcaggagcgggcggaacacaaatccatagctcccgagctttgcccactgtgtctgttgattccacagcgttggattgagagcagtccacagggaacttccgcagatcttgcacttgtggttttcccgattctcacttctgaaaaagcgggggcctgccggcacacagtaggagactccgtctttgctgacattctccatgatgaccgctccgcaatccggacaacaaaacacatgccgaaaagcgctaaatcctgctgcgggcatttcctcattggcgtgaggccgggcaatgttcagcccctcacgattccattttcggaaaatcacagcgggagcccgcatatagccgtctctggccttttccttagagatgatggcaaagcagttccggctcccctgctcgtacagcttgtaaagaagatcaaactcactgatactcctgacaactgcggcaaaggtgtttgggatgctttcttcgatttcccgcacccacttttttgtgacgtgggcagggcagaggacaatgctgaaggtttttgagtggcccgcgcttatctgatgggactgtaacccggcggccgcaactgcaacgcttccgatcttggtctttccggtcccgcatccggctacgatcagggcgaccttactttggccgagcttacgtttgatcgattcagcgactgcgagctgggcgtcataaagggaatatccggcgtgagcccggatatactcattgatgtctaatacttcttcagagagcggttcagtggccggatcgaacaggggaacaaacagcttcttgatccgctctgccacggcaacaccaaaggtgttcagatagtctgttacggagtgaactccatccagcagagagggccccggggctgcgcccggaattttgatcttgccctgcttcaggccgtcctccatgaccttgaccagattttgatccttcgcttcacagcagagcttccatgcctccaactcctgatacaaagagcgcaccctgagagggcggaggattctgcgccgctttagttccgcgagaacatagtcctgatattccgggatcatgggcacataggatttctggtcaatggcctggaacaattcatcctcatttccagggtggcagaaaatatagcagatgtgcgctggaatgtcctgctgaggcacatcatcatcaaacaggtcgtctttctgcgcgtgcttcctgcttttctcgtcctggctttttgaactttcctggatctcatcttccgcaatcaatgtggcttccgcgtacaatccctcatggctcacctcccggtggtattgcttggaaagcgatttcagcgtgaggaggctaccgtcaacatcctcgatttcgatggtagctccgccatagatggcgtccgtaagcccccgcacgacttcggcatagccgccgaatcgcagtccggctaatgtcggggaaggatcttcgctccagatcacggcatctgcgtatgcgttcagccgtatcccttttttgagatcctgaggtcaggtagaataagtttcgcaaaaagacaaagagacatggtttgcagatgtctggtagaatgaagttgcgacaccaccattcgaaaggagacagcaaaccatgtccgaaaagattgtacagctaaacgaagaagttatcaaggggcagctcaaggaacttgtgcgcggaagcgtagaggaaaccctcaacgagctgctggaggccgaagcggagaagctgacccaggcggcccggtacgagcgcaatgagcaacgccagggctaccgcagcggccactacaaccgcaaccttaccaccacttctggggatgtcacactcaagatgcccaagctcaaggggatctcctttgagactgccatcattgagcggtatcgccgccgggagagtagcgtggaagaggctctcattgagatgtacctggctggcgtatccgtccggcgtgtagaggatattaccgagactctctggggcagtaaggtctctccctccaccatcagtgagctgaacaagaaagcgtatgtccacatcgaggattggcgtaaccgtcctctgcaaggcgggcggtatccgtatgtctatgtggatgggatctatctgcgccgcaactggggtggagagtttgaaaatgtggccatcctggtggcaatcgcggtcaatgaggacggatatcgtgaggttttaggtgccgccgagggcatgaaagaggacaaggccagttggatcaacttcttccagtggctgcgtggccgtggcctggacggcgtgaaactcatcgttggagataagtgccttggtatgctggaggccgtgggcgaagtgttccctgaagccaaataccaacgctgcaccgtccacttttaccgtaatgtgttctctgtcacacctcgctccaaggtgaaactggtagccaaaatgctcaaggcgatccacgcccaggagagcaaaaaagccgctcgtgaaaaggccagggccgtagtggaggagctgtgttccatgaagctgaaagaggctgctaagaaggtggaggacagcatcgaggagactctgacctattgtgattttcccagtgagcattggacccgtatccgcaccaacaatgtcattgagaggctgaaccgggagatccgccgccgtactcgtgtagtgggcagcttcccggacggcaactctgcccttatgctggtctgtgcccggctacgccatgtagctggctcccagtggggcaacaaaaagtacatgaatatgaagcacctggaggccgccattgaggatgcctccattgccggctgactccattcatgccagagcttgcaaactaaagtgcgaaaaaatcttgacacgaccgatcctgataggtaactttcatgagccttttggcttccattcatggacgtactcctttcgttttttgcacaaaaaaagccgcagtcccctatgaagtgggtaactgcggtttttgtgtcgatgttaggtatttaggatgtggacaagtctccacaggccccaagggacccatgggagcaatctccgacctggcgaaatctggcctaaatacaaatagagcataccatatcagaatctgtttggacagttgcggttttctccatgatgagcgctgcctgtacgttgaacttataaacaatgtcttttgtctggcgagagcgggaggggaaagagacggggcccaacagcgatcgagccagccgttgtctctgcaagtgcttccgattttgtgtttctggatgggtcagttcatctcctgacgatcaattaaaaggtatccgcgtctctttacagatttcagaatataccggctcgtctctgaatccagacataatttctttctgaggtttcgcatataattactggattctgttaaggtcgccggctttccgtttctctctttggtgatgatttgaatgatctccgaatgcgatacgagctgtccttcataggccgccaacagatgaagcaaatgaaattgtgcccgggtaagcgtgtattgtattccatccataatgacctttctccgcgctggataaaatctgattccgaaagcctccgtgacaggctcaaacccatgggtcattaagagatttcctgtgctgccggcgtgttctataatggactgtatattttccagcatgtttttttcttcttcctggccttccgatacaaatgcgaataccttcataaacacttcctccgtatattattttcaggcaggcatcaatacaatcaattatactaatttatatttcgttaagcaatcatttttctgttgatttttgacggaaaatgctgcctttcaactttcctttggactccatagcagcctggtttttatcatctttaaccgactatgcccgttgcttggtagattgttcgcttttatagcgcacatataattataggtgattaaagctaaaaactatgtaatacaaaacatagaattatatgtatgctattttatcaaagggtgttgcaatgaaaagtgtgatggaattgctgtatgagcttcgtgttgatcatgatctgacccaagcagaagtaggtgcggtgctggggatctcccaacaacactactccaaatatgaaacgggtgaatatgagcttccactccgccattttgtttcactggcaaattattatcaggtttccgccgactatctgatcggacgccatcacaatctggagctgaaagaggaagacatggtttacctgaccgcgcaatacagctgcggaaatctgctccgtgatgtgatgggcctcagtgcgaaaggccggcaggctgttttggaatatgtacatttgttgcaattaaaggaacagagcaaaatgcggattgaactggttgcccgcatgaaaaaagcgcagaattggagcatgaatagtccgtccggatgggcgggcttttcttgtgcatacatagaaattttggtgactggaacactttcccgttggaaaattgtcgagaaatatctaaagaggatattttacatctattctagtcaacattatatcaggtttcattgtaaaatcaataaactggataaaaaacatctgtagtagataggtgtaggtgagtatataaagtgggaaagaatttgtttctgatccgaggcaatatatgcgcggagcgcgtccggctgggccgggcgttgcagaagcctccgatgacgcaggacgacctcgcacgtaaaatacagctattggggatggagatgacccctttaattatctcccgaattgagaaaaaccagaggcatgtctgtgacgcggagctgcgcacccttgcaagggccctttctgtatctatggattggctgtgtggggatacagatgcgctataaacacaggtacagcaaaagaaaaatgggcgtaacgctggagcgctgcgccctcgtgataaaaccacaatctttatccgtatatgagaactttaggcgccttctttagggccctgtctcggtgccaatctatcgtattggatgatagtgtctccggtctgtagattgagtttttcttttttcagcaagatataacgcggctgaccctcggcatagtccttttccgattttgggaaaaaggtacggcatacctgcgtgtcctcgcccatacgccgtgccagaaataagtataccggtgtaccctcgaaactgttttgcagcaggtagtccgcctgaatcgctgaaaaagcatgtaccttggaattatagcggaaaacaatctcgttgctatccagaaattcttccagatgggccagcggcttcaggcgcggctccatctgtttgaaaaaaacactccgctgggcatgggaaagtgtaagatttccagataggatttcctgcatgatatttgctcttttcccggttagaaaacggacattatctgtcagcttatgcaggccggccaggtgatgaaaatctgatggatcaaatgagattgtaaaatctatggtccgtcccttcctgcccgcaacaatatgatattggtaggtaagcagttgatggaaaccaaccgcacatgtttgaagtaaatccatcctgaatcctctttcatgtagcagaaaaccccgccgtaaggcggggctttctggtgcattttctttcggctactcaaagcctacgccggtttgaggtttcgctgcacaacccctcctgaaagctccataagacgatgccgaccggcgcaccctcctacttcaacgcttggacagacacacgccgttgcctgtcttacattattataatacgcagtatttcagaatatgtcaatatatttttggctagttgtgttgcttcaaatgggaccatagcatgacattgcggtggtcgctcttcttgcaaactccaggattataggatagaatatgattgataatctgtaattatcttaacagtgaaagtgagcagattcaatgacagacaagtatattaaaacatcttccaagagcagaaaacttgtgatatatggggccatttgcttttttgtggttgccgtcaacacagttactctaatttatgggatattcagtcactcgggcgaagagtatggtggatggttgattacaccgattgccggttttttgataaactgttttagcatattgtactgcattctgcaggatattcgccagacatgccaaaagccccagcctcattttgtgtttcaaaataaacatgacattccatttgtagaccgtgaagaccttattgaggaagtattgtctggtatttctgaaaaaatagtcgcgcatagggattattatacaaaaaatatccgctatggaattcggaacggaaagacctcttttgcacaaaagctgtgctgggaattacaatgtatcaaagatcaaaaaggtagtgattcccacaacttttcccctaaggtcgcttcaaaaattggaaatatatacctggtaaattacaccgactatggcgatgcctttggaacacacatcaaaacagattatacgtatataaaaggaaaacttaatctgatagtggtgactaattttcagaatgtacaattcccatggaacgatcacttaaaagatccagatgtcttttttgtgttgcttaatttcaacgacacttcagaagatgccttattttttgcagatgacaaaatagtttgtctgctaaactctcttaaagatttacctgcattctcttcgttggtttccggcaaaacccaggacgaaattgaagcaatggctgtaaaattggggagtcttactcataatagtatcggcgcaatcgttgatttgcttacatctaatgagtttttgcttttactggaaatggacgccccgtttgtggacttctatctagcgctaaaacgggggcaatacgttcaagccgagaagctttatcatatattgccgccccctcctcctaagaacgtggctttggggtacaaaatggaatatgaaaaggcgaatttagatcatttccttggccggtatgagactgcatatgaggctcttaaccatctgatggctcagatttgttgcaacagttcatttatggacagtagtattggaagatccttgtattgcaatattgtttttcttctgtcacatattctaaagcacctcgggcgatttggtgaggcagccagtacccttcaccaaatagattgtagtgatagaaatgcaatctggcttagagcacacttttctctcaatatattgcagttgaatgaactcgttcagccatgctcagagtggggtgaacttttacaggaactaaagcaaaaaatgaaacagttcaaggaaatgcggaaactgatcaattctgattactttttttatgaggcttattatcccatagtcgccttctatgacagccattttgatcgcgctcttatcccaaggcttcttgaaattgaggagaatgccattgcgtattacgaggtcgaagaacggcgctatttgaccaactgctactttattaaagcagagtttctgcgaatcaacaaacagtggaaagatgcagaaaaatactatgccttatgctacgatatttgttccagcaatggggataaagacattttttatatcgtggctataacctgtacgtgtcttctttggtttgaggatgtaaaattagacatcccattcgattgggataaggcacttgctgaatgcaagcaacaggatggatatggctttcaccgtcgccttatttcacagatggagttgtccaaagcaaacgaggagtttcgtaaaagttggctatcgcactaccgtgtcaccattactccaattccatgaaaaggtcatctattacatactgatcacttttgcacagggccaacgtagccttcagattcataatttcatggtacttttcgggtgaattcaatacaaggcacagaagatgcgctagattggcaatatgttcatcaaaatggtatcgggctatctcctgaacgcccaaccgaaaaccagtcaaataggcagttttacgtttgttcaatgtaattccataatttcggaagtgtgtataggagatgtcaacttgctccttaggaacctcaatgaaaagctgatgtgtatgagagaacgccccgtcctcagtacattttacccgtagaccatccccgctaagagcatcccccagtgcaggccgtccatataattttttgagcgtatgcttcaccgaatttcagcatttcaagcatagatagacatacactggtaatattgtttacttggacattccgtaaaaagttgggcgaaatattctgttttaccctgttgatatagttgtcgttgttggtcgctacatagccacaggttacactcggaaaagtcttatgtgtccctccaatcattataatgttctggcatgcctccaaagggtttggaagagcccctcctgcaatgagtcccaaagtttgtgtagcatcatatatgatgccgacctttggaggaagattaattttttgtagttcaggtggctggataatgtctgactggcaaaagaacaggaatgatactcgggaatcctgctctaaaatctgattgagaccgtcataatcaatctgcattcgcatataatcgtaaggaatgggggcgtattgaatccccaaattgtcacagagttttggcaacgaaccgtgtccaccggcctgaggatcggtaataagtatttttgtacccttatctatcagtgtcataaggatgagggccactgtgttcattcctgtcaaactacgaaagtcgttatattttgcatggaataattctgccgccatgtcgttggataataaaagaattttttctaagtaatcactgccaataaagtccttttctttgtctcgatcgatatatcctgaaatgtatttgccctcatagttagagattaggccctgctttacaaaaggagaagtataattttctgcagcgcagaggggaatttttgtgcggtcgaatactttatattcttcatatatagtagttctgctcttggaagatgttttaatatacttgtctgtcattgaatctgctcactttcactgttaagataattacagattatcgtgtgttttggcgcaaaaagaaaacgggctgccagtgatgactggcagcccgctttcttcttaccccttgcttgcttgtaggggacgacggtaattattatttgcttttttgatggtgtatttctttcaaatcctgtactgcaatttctggctctagggtatggaacatcatataatttcgcttcatggtcctttcgtttgcctggcggtagatttccaagctgctttccccggtcaagtagtgccaatagcggtataaatacccgatccaaaaaagaatttctttttcatatagtgcacctgtaacaggtaaagttggaacttcagattctaattcctctaaaaggtactcctctccagaccattgcattcggttatagactgaatccagtgatttggccagtctggaccgcatgaatgaagatatgaagggtccgctatcataacacgctttccgggacaactcaaacagcctaccctgaacatcgcatattttaagctgtaaactatccattatacattctctcctgctttgttcatgatttcatcgaaatatcgtccttctctacgatggattttacatatttcattggctagggagacgcccttgctcctgttctgctcactaacttcctgcaggcaaactcgttccaaatgggacaaaggaacctctttctcaattctgattttttcgcaggcgtgttcattgatcgccacatattggcggcccagttgtaaagcagacaaactctgaatcagggctatatctgttatatttcccaaaaagaagttatccagcacataaaacatacggtcatttgcaatggcgcctatcagtacatcatttccctgtgccatttgcgcgtagtgccgatacaaagtggttcctttaatcgcctccatctttccacggtagaacgctacaagcatggcccaatcgaggtcaggggggacttcaaaaaccgacagatcagtcaaatctatggacaacacatagaatttggcctgctcgaaatcacaaatgagggtcaggggctgcaccggatctgtccccatatagaatcctcggccaaaatcacatttgtcccggcttataggtgcgatcgcgccagtcaggccgctcttggagccatgataaagaaggactcgattcggtaccagtgaaacaaaggactctttccgaatatggtccatcaccagctcgtaaagctggatgccctgatctgagcagagacgcatgatcttatcctgcgtctttctacctggaactgtacggccattttcccagcgattaacggtggcgaacgtcgttccgagaagatctgcaaaccgctcttggctcaaactaaatgcgccccgaatttcttgtagtaactgcttcatatcatgtcctcatcacatataacatttttaacaataaaattatataaaatgttatatccgaagtcaactgaatgtcatagatctctatcagaaaaatgcgctatttctttctgtctcaaaacagcacttgcaatagtgcaaaagagtaagtaaaatgtaagaagggaagactttcgatagataatctcttattatcaatcaaagtaaaaattaagattcactgttggaaagatatatggagatgcacgatggagaccaataatacagatcatgtccgggcactttacaatgctgtaaaagagacctggccggctgacgatccttggcataactatacacataattatgttacccaaaaggtgcaattgtatctggctacactccgttcaggggcacttgttttgaatgcaggagctggcgatacacgatattgcacttctgcgacggtttacgatgtcgatattgcggaggaaaagctgaaaaattcatcgcatccctttgtctccagcattgagtcgctaccatttgtagactgctattttgattgcgccatatgcgttggaagcgttttgaactattgcgatctctatgccgcgctatctcaactcattcgtgttttaaaacctggcggggttctgtgtattgaatatgagagaagtcagagtgctgagttccttttgacgaagaactacaatacaaatgttttccccaaaatctatacttacaatggacagcagcatcgactttggctatactcagattcttatgtgttgaaatttttcaaacaacagcacattgatataatcagcagagactattttcatggagtaagtagtcttgttgcacgatttaccggagacgaacctggagcatcgagattagcaggatatgatcaccatctcccctggcttctcaaatttactgctcataattgtctcctctgggggcaaaagatttagtcctttgacttaaaataataggccgttaccccgatggccagcgttgttgtcgctgcatagattgcagagaaactggtaagtgaaatgtttaagtagaggatcaacttataaaatagaatagacaataggaaggttgtaaaaatcattagaacgcttattggccatttaggaaatttccgcttgctttgtggggcataacctgcggtagtcatatggggcgctgggcaagaggcgttgaagtatgcacattcacaggagatacagtccaccaatttaattgtctgtccgctttgtagtgattctaaaatatccgtatattgattatcaatgtggttgtgatattgagaatattccgcatccgtcaaaaaatcctgataccattgatcatagtgctcgtagtaaatttctcgaagcaaggtagaatagaattcttgtgtaatcatataaagcggcgctgatgttttgaggtacagatgtgcatcaatattgctctcctgcttctgaattccaaggcagggttgtttatatttggcgtcgattattttaaaatcttccattgccaacactttacgcaaaaatgcgctatcgttatcaaccgcctcatcgtgattttgtgcgccaatctctgtgataaagtagtcgtaattcaatccaatatcgttgaaatagatcataatcatgctaaagaaaggataaaaaatgctattctttttataatcttctgaaatagctaagtagtccatgaacagaactttttgattaggcaaaaaggcaaactgggcaaagccaatagtagcgctttgataccgcagggcaaaaaagaacattttccgaccatttgcagcaacaggatgttctaaagaataggcgatctcgtttgtatccgttttgacatcagccggcatgacacgaagataaaccttcatagcttctacatacgcattatcgctcgaagaggtcagaggctttaattcatatttttgattcataggtcatccctcaagtcatgtccggcattgggctgtcgataataagagattatctgtcgttccaagtggcagactcaagggtgaccgttgcaaggatagaaatgtcctgcaacggtcacctttagataatgcatgagatacttttggttttagccgtcaaatatcctttctgccgctgttagcacgtcagtaatttggatgaaatggactcgacctgatataatgcttttttagaggtgaaaggacatcttgcatctcggatgcagctggcagaggaggtcagcctgccgctgcgcggccacatgggtgtagatttgtgtcgttgaaatggagctgtgtccaagcaggctttgtatgtaccggatgtccattccagcctctaggagcgtagtggcgaaggtgtggcggaacatatgcggtgtggccgcatattgctcaggcagcttccgcaggtattttcggatgatccgccgtactgactgtggagagagcgctctgccgcggtcattgaacaggacagtgctggacacttggattttgcccccaaaggtctgataataaatgcgcatgagctccagaagttccggcgtatcgatctgaatcacccgctccttttgcccctttccatggatcagcagcctgagcttatgagccccaagctggacggtttggggagagagggcgcatagctcggaaacccggattcctgttccgaacagcagctccagcacgagaatatcacgcaggacagttccggctcccggctggtactccatataggcggcttccagcagatcccggataatatgttccggaatggtacgtgggagttgccgcggcgcctggatatggatttgcagtttttcaaagggattctgtgaaatcgcttcccgtgtctccatcaaacgatagaaggcccgcagggaggccagcttccgtttgactgaccgcggcgcgaaggagttgttcagatatttgatatactggctcagcagatcccggctgacctccgcgcctcccacaaaggcgcggaactgagcaaggtcagttcggtatgccttcagcgtatcctgggacagcttcttttcgtattggcagatgtccaaataacactcgatcagggcttcaagattgttcataatcgatctcctccgttataaaagctggagaccattatacaataaagaaggatgatttctggattgggcagcctgatcctttttctgcacagcctctaaccggactactgctctctccacaggtacgcgtttggtgataatgggggtccccatgaaagcgaaacgcacggcagatggataaaattagaatgtctttacctcgtgtctttgtctgggtgccgactggattaaaagagagcggggcttatgccttgtctcacaaggtcagcaaaaatttgcttatcacgcaaatctctaagttcgatcctttgtaaggagccatcttttttaatatgacgatacactggataccacgaaaagcgcataaaggaacaggcgggtactgcatctacaagatctccctgcccttaaactttatatatgtccttgttagaagggaccttttgctccgcccctctttatgattcagaaagaggggagaaagctatacacaggaaggcccccctgaaatgggggggtaataggaccaccaggcaggtgaggaatatgccccatgattctaatattattaccatctatcagagccgggctgggaaaatctttattcaggcgcccatgcgtgaacagcaggcattggatattgcgagtctaatcaaagaaggccatattgtggtgcttaatctggaacgatgcggctcagtggaatcccaaaaattgctggattttatatctggggcgtcctatgccagagagtataaaatgaacaagattgcggtttcaacctatctgatagcaccaccagaggtcgcggtcatcagctcgatagactaggctatatagatgaatctcacaatttctatggatgaaacatacaaacgagaaccgggaaaaataaaaaaggtcccatccggcatctgaaccggacgggacctttttgtgtttatgtgattctagtgtgtgagggtgaggaggaactggatgctataccggatgtctgccgtcctcctgcatcggaaccagcagataccccatcgcctccagccattccttggccgggtattcctcggcggagatccgtccaagggcgtccagtaccgggtgccggtatgctggtgttctcaaatcggagagacagacgcagccgctcatctgggccagccggtccaacaatcccatctgctgatccattttcaccacctcaccacttggagagaatccggccatagatcatgctgcgttcaaagttgtgcttggtaatcacaatgattaccgaatcgcccacatgaaattcacggtctctctgctgagcggaatacctgcacaggcacacagaatcatccggcagggtgcagaatacgcctccgccatacttgccgctgatcgtggcctgccgtctgctgttgacgggatggcgcatgatggctccctggaaggggtttacggtggcggccttgacggaaatgttcatcagctgccggtaggggtcatattccgtcaggacgcaccggagcttctggcccgggcggtagcgttcccgcaggtcaggggtcgcggtataggtcagatccgcctgcttgagcgtcatgtcccgtccgccacactcgaccatgcacagcctggggccaacggataccacccggcaggtcagatactcaccgatcttgtggccgttcttttcggcgttgaaatagtgctgcctggcggccaggccaagcttccgggaggcgatagccacgccgccctcacggtccacatccaggatcacatagtcgatctccgcgcctgccatgccgcgcaggacgtgggagggccgctctgagccgggctgccagatctccgtctccgggatcagaactttgacccggtaggcgatgacaactgcacagaggatttccctgtactcgatccgcttggtgtcccggtccctgaccttgaaggaatgggtgtcgatgccaacgaccgtcccagtcagaatcgtccgggagcggagagacgcatagatctcgttccactcctcacgttctctgtctgtcagctcccgatccaatttgttcagatccaggtcggagagggtgggcctaccctccaggggcttgtccttcaaccggtccgtctgggcggtgcccttcacctccgccttggccctgctgcttttctccctccgcgtccggggagcctgcctggccgcccttttggggccgccagccgccatgccatccggctccgcgccggcgtcttgctcagccgctgcgccgtcagcctgcggcccggggatgccggattcttccgggaaaccgtcgggctgttccggggcttcacgatccatggcctcctcagcggcatcttccgcctccccggtgccttccggggatgtttcgccgccgctttcgccgaggaccgcgtcaccttcagcgggctcctcctgctttttctttccgccgcgcttccgtgccggctttgtcccagacggctccgtggtatctgcttccggctccaccgcggccgtctgctcctgcccggcaacggagccgctttcttccgcgggcctcagctcctcagatgtgccctgaacgccgctggtatccgcggcctcattctccggcgtagcctggatgacgccgctatcctccgcttcgttccccgccgcatccggtccgggccaagcgctttcgttcatgtagctcatactatgtcccctttctgtttcgtcaattattttggtgctctcgttcagattccgcgctcagtttcagtgcctggcctcaccccctttatagaaacgcagcttccctgcctgacgcacgacaaaatagcagctctgacggatcgtaagcgccccgtgctgccccaaatcgtccaggcgcaggagcagggtagtttccggcgcaagttgattcagaagcagcgatgcctcccgctcatgcccctgcctgacgatcatgaccgcataggagtcgatccaatcctcaccgcgctggaggagaaaggagagcttgcagggcgggttccggctcacctccagaagcctgcgcccggaaagcgccagcaaaatatccagcgcctccagcatctccgggtccggctgctttttcagcatctccggggaacagagaagctgcccggagaaagcaagctcgccgacatagcggagctgccggatcagcgcctccgtctgcccctgggttttgcgcgggtcaaacaggcggagcaggggaagggcctggtccggccggatgaagtccgtctgccgcaggacagacaaaaagaatttttgatcttcaaataagtacacaatgcctcagcctcccgtattgtctggcccgctgcgatcagcgcgcaggctgttgatataggggtcgatcatcacatcacagtgcgcctcattgatggagctgaagatgacctgcatgacataggcaatgggatttcggacctccctttggttgtttttcagctttccggccactacctggagcatggtcccgtccagatcccaaagacgggagcggatgttcgcctgtgggagtacggccttccccacccgcagtccgtcagaatagaacaggcgttcaatagctgtttcaaatacctttgcgtcctccgggtcaaaaatccacaggtcgcagttatccaggatctgtcttagctgcgcctgttcctccgtccgatccatcggcgaggcgccgtatccgccgcccctcctcagggaagcctgctggcgctggatagattgacttgactcagtatgaatcccatcagtatgactcggatcagtataactggggtgcgaaacgggcacttctggatgtgccgttcccgtacttgcagaagtgcctgtttgggatttctgcaagtgctgttctggcacttcttgcctgagtacggacggaccggcgccatgttgctgtgcttgaagaagttccgtttccgcacttcttgtgccggcttcctctgccggcggagccccagctgcctcatgcttttttgagacaaagggggcgctgctgttgcggcactcctggtgctccaccagcgcaagatagatttgattggcgtcgccccgaccgcaccggcgctcccagatcagccccgcggcagacagctctttcatggagtcgatgactttgcggtagctcacctgcatctcatcggcaagcgacttcctggtgtagatgataaagacctcgcccgcgtcattgatccagccgttgagcctggagagctggaaacggttgagcaggaaggtataggccaccttggcctcaagggacagggccgtatagcgcgggtcggtaaacagccagcggggcatctgcaggtgatagacgctctgcacatctcccagcttcatgagccggaatgcaggcttttgtgtcataggtgcagccttcacaaacaattcctcctcgccccgccgccatatgcgccctgcccacacggcgcgccgcatagatggcggggattgattttttcatcgtttctcattacaataaaaagcacagcctgcgctgtgattggaaatacacttgaattgggatgtgtcttttatgaatcaaaaagaacttggcgagcttcgccgccgtttccgcccggatagaagcgcggtaagccgtgtgtacggctgctacgtcaacagcggacgggaaatcatttcctacctagacgagtccctgggccagatgccccaggaggaggccgaaaaatatcttggccttctgaaaaaggcattgtccgggacattggggaaaaacctgattgatattgtcttttccaccgaacgggtgatgaatggcccggagcaccggctgctctctcagctccgctcttccgccctgaaggatggagcggcccgggatgccttttatcaaaaggtgattgaaagcctggatatgggagagagcaattatctgatccttctggcgcatgacgcatacgatgttccgcaccggggaaaggatggtgaggcccaggctgacggctccgacgaggtattccaatacattgtctgcgcgatctgcccggtaaaggacgggaagatggagctgggctttttcccaggggaaaatgagtttcacagctgcgcccaggggcaggtcgtggcgcctccggagcttggcttccttttccctgcctttgatgaccgggcagcgaacatctataacgccctgttctattccagaaaagcagatgagctccatcaggaattgatcgacgcagtcttccatacggagcctcccatgtcacccgcagagcagaaggaggcgttccagagcgcgctttgcgactccctgggggactgctgcaatgttgaggtggtccaaggcgtctacgaacggctgagggaggtcatcgagcagcataaggagagcaaaaatccggagcctctggcgctgacggtgggggaaatcagctccatcctgcgcgactgcggcgtgccggagtccaaggcggaagcatttggagaaaaatgcggggaatcattcggcgccggcgctgtactgaatcccgccaacctcattgacagcaagcgttttgagctgaaaaccgctgacgccgcggtatccatcgatccggagcgcagctatctgatggaaacccaagtcatcaacggccggaagtatattctcgttccggctgacgagggtacggtggagctgaatgggtttcccgttggcatcgccggcggagaggatgtccagtcatagggaaaatgggacggtcgcaggcggaaaacgccgcggccgtcccgtttctgcattaaagcggcgggcctcctatatcctccggcatggtctccatcagctccaatgcgccgtagggagcggtttccgccaattcgcctgcgtcctcctctgcgtcgccctccagaccgcacaggctggagtccatcaggccgtaggaatactgcggctcactagccggccgcctcttttctctccgggcctcccgttcaatccccacttccgggggagagggggtagccgaaggagatgggggcgcctggggaggctggggaggcgtggcatcagccgccggcgcaggcttctgtgccggctgtggagcgtgccgccgttccgattcctccgtgatgcgccagcgcggggtatggctggacacccggacatccttcagccggcagaacgccggaaattcttccggggtgatcttatagagttttaggacattttgcccccgcaggagcacaaggcactcccggttattcatgtggagcacttcgtccagatacataagagggcgctgggtgttgcttttggtctgggaatagggccgggtggtggaatacaccggtgagaagagcggggcaatgggcatttgattattctccacccggatggtggtaacgccgcatttctgcgatatgtactttgcggtgtccacatcgttgcagccgagacagatctgtacatcggtacagccgataagctcctcccattctgtcttgggatagcggtccttgagctgggggatcgactgaaccacaagctgacaaaagatgttggagccccggcacacctccaaaacgcgcttgaagtccatcagctttccgatattgcagaactcctccagacacacgttgaccctgaccggcaggcggccgtggtctccattgcggcgtccgtattccatcaggctggaaaagagctgggagaaaaacagggagcttaaaaactccagcgaggagtcctgcgcggagatgcagcagaagtaggcgcagggcttttgcccaggaagcgtcaggtcgatctcattgtaggaagtgatcttatccaccagcggattttgaaacacggaaagccggtttccgagtccaatggcgatattgccccaaatctggcggttggccagtttgaaaatgccgtagggcggcagggcgggatggcctttgggcagcgcctcaaagcgctgctccagatcagcgaaggactcgttggaaaggatgcggtagatttcccccaaagaccgctgctggatgggcagaagctggttggtgcctgggatggtctgagttgcgacatagtgcatgagtgccatgagcagatttaattccgccttctcccagaagtcctgacgttcgttggcgttggaggtatttttgatgatgacctcggcaatggattggaccaggtttttgtcctgctcgatcacgctcaggcagttccaggcgtcgctatgttccttgtccaagaggttaaacatcttgacttcgtagccgtcgtcccgaaggatctgggacatcccctcgtagatttcccccttgacatccaccaggaccatgctctcccggcggcgcatggcttgaaggatgaagggcttgacaaagcccctggtctttccggagccggtggcgccataaatcataatgtgctccgtcagcccgcagccgggcttcagtgtcacatattcagcatatttgtcatcgtcgtccgggtcatccttctgcttgcccaagatagtcccatccaagtcctgaatgggaccggtcagcagcaccttctcctgttccttctttcccataaaggcagaggtgccgtgcgtcccgttgggtaaaatatcaaacccccgcttatcccgggtgtacttgtaccccgaaaaccaatggtaccctttttgggtgatgagacagaacatcagcgcgcccaccgcgatggttgccaggccggtaggggtaaacaccgccgcgaagttcacaaacgggttgaccacccagatgcttttgatctggtcggagtccgccccaaataccgactggatgcccaggcggatggagttgagcagcataccggcgaaataccatgcgacaaggccaagcgggatcaggtatttccattctcccttatgcctgctttgaaaccggtccagcttttttccccagcgtccggcaatgcggtcttccagcttcgccagcttttttgagagcctaaacatggacgaagccgcctttcagggtcagaggggcgtccggccagggatctccggtcttacagtccccgccaaaggccacggagaggacctgggcgttgatgcgtaggggtctgaccgtcgcgtttttgggcaggatggagagcagcaggccggacatctgaccctccagggcggccaccatgatctctttccggccctggcggacggcggcggtacacacccgatccaagcggcgcagatccatgtccaccgcaatgaccagcggatttccgtccacatggccgtctgcctccggtatcccatcgtccttgctgtcccagcgtgcgccgaaggcagcctgggcaatcctggcccggtagtcggtctgccgcatcacggcaagctgcatcacgccggtgttgtcgcaggatacaaggcaggccggaatacttagcttttggtatgcctcgctgtaatccacaaagccctttttcccatgccgtttggaaagcgtttttttcgtcaagacctcatagacggactggtagctctccccggccaggatcaaagcctgcggcgtatccagcgtttcactgaacacagaagccaggttatggaggtggcccagttcattggtcattacaaagccggtgttctgcgcgctgacgtacagcgtcatataggcggtagagccccagtggccgaatccggcacagccggcggcgttcatcaggttgcctccggcgtttcggagggcaaaggcggggaaaaagactggctggcgtttcaggtgttctaccttgccgaaggcaggctcaattcctgccccgatgcaggtaagcaggatggtccccacctccagcctgcggcggagggcggggctctgcgcatatgggcgtttggtaggcggctgacaggtctggtcgatgccggaaaggaattcatagccctggggcgatggcatcaggtactcaccgctcctggcatagctgaccagccccagggtggacagcagctccgcctcccggcggagcgtttttaatgcggaaagctttttcagcggcgccgcagggagccattgataggtccctgccaagcggagcaggccaaaatccctgcggtcgtaaagcatacgcaattcctcctctcggtgcaggaaatagaggcgtcaatgtaacggcagacggcgtaggacgtttacattccagatatgtcccgacattgctggagcggccaaaggggtgcgccgcaagggaaaacacacgccaccatcggttacattccaagaccggatgtaaccgatggtggccctttgttctgtatgtggaatgtaaccgatgatatggggatttgcgggtggaacgtatccgaaggtctacttcggaattgatccgtagttgtaaccggaggtcagggaaaagggtagatagttttctgcccggagggtgagaaagtcgcccgcgtcctgctccgggatgaggtagatatggcatacattttgtggcaggcgtctggagagaaggcacacgcccaagctgtactggtcgtcatccgggatcaggcgccctttgatggcatttgcgattgccttccagcccttgttgtcctggtcgtacacacgcctggcatcgatctcgcaatgttcatcaataatgagcagagcgtgttccagcatgggaagcctggcgtgggcggcctcatagcgatccagcgcccgggccacggtatccgacagccagatgggtgcgtcgtagcggcagtggggcaggagggtattgaggcggatatggagccagccataatcgctgcgttccaccccgcaggccaagtccagcggggccgggggaggcgcatcctttgcggtttccggtggaagcgtctggcattgctcgcagagccggcgaaatgccaccgtaccgcgttccagccggaaagcggcggcagacatttcccgggccagagatctatttccatctccgccgccgtccagcagggcggcgacccgccccgttgtcttgtaggcgtcaaacgcaatggcctggatctgcttgatcgtatcctggtcaaataacatagaagtttcctttcacagcataaagtaagaatttttcggggcccggtcaggcattgtttctggcgcgccggtccgtgggcgacgttgtgatggcctcatactccttgggggagacgaacacggagatcgggacatggttgtggcctatgcagagcaggccctcgccgcgccggaagcgtgtgatgagccgcacctcctcctccgtcagatttaggatattctggaccagccgagcctcctgttcttccatctgcatgatgaatttgatccggcagctatccaggatcgccttgccgtatttgccgccgtccagggccatcatgtccgccatgccctgggaggtaacgccggcaatgccgccctgggagcggatcagcttgaccatgcgcatggtgtagtccgcagccaggggattggaatttgcgcccaggagtttccaaagctcatccgaaagcagggcggtccccacatccccgttttgtacgatgacatccgtggcaaagcctgtggccgcgtagacggaaggaaggatcaggtcatccggcaggtccgtcaggtcgatcaccagataggggttgtccgtatcgacattggtgcgcccgcccatggccgcggcagagccggacacataccgagtcagtacaacggccagatgctttgtctccggattgtccatcagaacatcgtaccagtcctctatgaccggcatctccttcaatgccccgtcctggtcatagagtgtgctgttgtcaaaggtgatccccttgcggcggtagcactcgatcagggatgcgtcaatgtaggcccgatcctcttcgctgaggtttttcttctgcatggaataccacacactcagccaggacaccttttccgccagaagggattcccgccggtccccggaggaccgggagctgtatgggtcctcccggaagcgcctgatctccatcagcccgatgcagtccggagacgccgggccgagcttgataaactggccgccgagggattcacacagggggcggtactcatgacctttttccgggacaatgcagatgaccttgcgcccctgttcccgcacccgtttcccgatagattgcaggatggtagactttccggcgccggtagacccgaatacggcgaaattgccgttggtgtacttatagtcatcataaaagtcgatcagcacgggggagcggttgtagagattcaagcccaggaaaatgccgccggaatcgctgagctcataggaggcaaaaggaaacgctccggccacaccggtggtcagagcgtttcttctgcttttccgctcaatatccggatcaagccccaggccggggaggaatgataaaaacgcctgttcgtttttgaattcacagcgtttcgccagcatatccgaagcgacacatagcgtttccaccgctgcggcccgctgctccagcgtctccagatcatcagccactacctcaatcagcgtgtacataaagtacagatcctcgccctcgcggttgatcccctctttcaaatagagccctgcgttgatggcgtcgcccaattcctcgaagtcgctcctggtatcaccaacatcccgcatccgggagcggttaatcatggtggtctgagaaatggaactgaggattttttcccgtggctgttttcgcagctggaagctgacactgacaccctctcccgcttcaatcagcggggtgagccagccttttcccaccactgtggcgtatccatacccggcaatgtaaagataagtgtggtacacgccgtccaccagaaggaagtgaggggagtgcgtgtcaatggaggtgggcgcgatcagatcagggattgttgtcgcgccgccctccagcccaagcagctccgcgctttttttctttggcataaaccactttttctttttgacgccgggattttccggcttctgctccagggctgtgccgacaacgctttcatcgtaaataccgtggatggtccccagcatatcatacgcaccctctgggagcctgatatgctgcgaggtatgcttattgaccagttcataaaagagctccagaacaaaattgtccacatactccggttccagaaccgaaatcccgcatcggtccagatagcgccgcgccacttccgcctgttcgttaagacgggcggcgatggcgcctggagaattgtttgccgctttcatacctggctcataagaaaaggtcaggaaaaagcggtgggtgatagcctctcgctctacaagctgggggacatactgcatactctccagaatcatttcacggcagctttcgttctgctcacagtccaaacgattcttcatcagcttcagatagccgttcagattgaatttttgagtcaggacgttgatctgcagctgatcgggagccaccttcagataggcggcgaaatcggcgattgcgttgccctgttccgtttctgaaagtgtgtagaaattgaccggcagaagttccagcactttgacaaagcgcttgtcccgggttatgatgactcctttcagaatatccttgatgggcagccactcctggctgctcccggaataggagccgcctaagtcatggacggccgcagcggaattgccgaagataacgtctttcagattcatgcggatgcacctctcctcgatatgttacgacccggcggcgttggcgccagatccaccatgtttttaggtatcttgtcaagctgtcgtccttgagcccaatcagtgcaaagccaactgtggggaccaaaaagaacagggagacagtgatcttccaggtaatcaccagcggcagaaacctggcgcagagagcaagcaccggaagtccgatcaggacagcctccactacattccggatctcgaacaggccgaatagttttccggcgtcggtgtaatttaccggaatgtgataagtttcataccccatcctgatccccctgttccatcgcaaagatattgggacaggccgacagctcagcttccatctgggccagttccgcatgacgtgcggacatcagagctgcgcaggcgcgtctcagcatggcctcatgctgcggcgactgccggccagaatccagctcaatcagactgagcagctgggatgagatcccggcacagaaggccagttccgcaatcgtcaccctatgccgcagtctgaacgcccttatccagcaaattttatccatgtatgctgcaccccctaagaaaatacccagaagggaccgcccgcagcggccccgcgccgggcttcattcactacaatgccgagctcccattcctgattgcttcttttgacgctggccgggtcggcaaccaatatttttccatcttctgtgatgccgcgcaggacaataaaatgtccgccgtttgtaaaatgcccctttgacatcagggcgatcaccagtttcccgtcctgaagcgcctccaccagcttggtgctgttgtttccaatcccggttactgtgagcccatagtgtgcgccgccatccgggatcagactgtgatagcttccgttcccctcgcagcggtggccggtctccgccgaccatttcgccacatcgtaaggcgtaacggatgaatccaccagcgtggccaccacaatggccagcgcggtcggcccacagccttccgcgccaatcgtcccggtcttcccatagagcttgttgccccaacgggcgtccgtctgattgtagtaaaccaccggggtgttctgatgctcgaaggtcacatcgccgtaatcggtgttgtagtagccatccccgtccgtatcgtcgtatgatacagactgatcatccgccaggacggagtacaggagggaggcccattccttctcctcatcggtgaagccgagtttttccatatatgcctccggagtcatgtcccagacagtaatgttcagtgctcggtcaatcagagaggtggaataatccagcttaccgtatatcaagtcatctacggcggcctcgtccatggccgtcaaatcctgtttatacttggtcgatccgatggcaaccagccagtattgattcaagttccccagattttcagtgacggaatagctgtcatactgagcgctcccgtctggaagtcgaaaaccgggcaggatcgtattcaccaggcgctccaaaatggacggagtccgggaggtcgcctggtcataaatttgggtcagttcttgagcagagtctgtaaattcgatgatttcctgatctgtcgagctgttgaagccgaacagaatattggggagcgacacgaaggcgaacagggggaacaaaacaaccacgaacagaaggatcacacccaacttgataagctccggcagaaaagacttggcggcctcggcagccgcgccgtacacccctccataggcggcgccgcgggcaatattcgcggccgctgcggcgacacgaataccctttcctcctgatccggactgataatcgttcatatactaaatacgcctccttctgattcccgtttgactctaatttctaaaggcggagcatgggcgcttcctatgcggcgcacccatgctccttgaggatttcaattattttttcttattgcgttttttggatgtgctgccattgggcggagccgccggccgtttgatccggtgagtccccgccgaactgtcttttgccgtggtttcttcggaagccgtttggattgtaggcggccttggggcgccggaaattctgcgtgattcctttgccccggtggaagcctgcgtgccccctatgggaggccggctgggaccagcggcccgctgcgtccctgctgtaccggccggaggctgagtgccgcccacgggaggccggctgggaccggagggctgccgcgctcctgccgtaccggctgggggctgggtgccgcccacggaaggccggctgggactggagggctgccgcgttcctgccgtaccagctgggggctgggtgccacccacggaaggccggctgggaccggagggctgccgcgttcctgccgtaccggctgggggctgggtgccacccacggaaggccggctgggaccggagggctgccgcgttcctgctgtaccgactgggggctgggtgccgcctacgggaggccggctggggtcggaggcccgctgtgcccctgccatatcggtcatgggctgggtgtcctccccaggatgctggcttgagccgggaggccgccgtgcccatgctgtgccgatcgtgggctgtgagctgcccacgggaggctggccggaactggaggcccgctgcgtccctgccgtaccagccgggggctgggtaccgcccacaggggggcggctgggactgggagcccgccgcgtccctgccgtatcggttgggggctgtatgtcccttctataactggaatccggctcttttcctgccccatagtcgcttttcccgggcgcagatacgcctggaggagtggagattttaggcgtaccgttttggcgtatcggaggccgctgcggacggtcctgagtggtttgctgagacgattgccgctccgatgtgatacgaaatgcttcttttccggttttccgataggagtgtgaaaaagtacctgccgcatcggtagcctgtctggaatgtgctgcggactgatgctgggaagatgctgcctgcgtggccgcctcagccccttctggcacctgccccataagtaccgcgtttattctgaagcgctggccggcaccggctccaccgcttctctgctcgggaggaacagatgtatgccgggttggctttgcgtccggcgggcagcttgggcctccggacttgggctgatccttgcgcgttgaaggcggcgctgtctgtgtttcagtagaggcagactgctgcgcgcttgtgcttgccgcatatgcagcccgttcactctcccggtgcgttccagactgaccgcggcctgggccaccctgacctgacccgccgccaggcggcgtagcccccccacccccggatggaggcggagaaggcggtggggtgctggagctgcccgcagcgtggccgccgtggggctttgcgccgccgcttccctttgatgcggccgatgcggagcgggttacagccattccaagcccgcgaatggccgcaaaggccaccataccaggtaaaccacgcccaagcccatccccggtgattgcgggatttaggccgattcgtgccacaacgctgtctatttttcgggctactcttgcaatgccgacaatcagaagcatccagggcagcactcccagaccggacggcacatagcccattgcggaaatcagcagcttcaaaaagatgatgttcataaccatcatcagacacattgaagcgaacatccggcaccagcccttgaagatgtcctctgtgctctttgagccgcctagtccgaacgcaagcggcgccatcagcaccagaacagcggtcactacataccgttccgccacttcaaagcacagcttaacaaactgccacataactacaaagccaacaatgataatcagcagccaggacgccccaatattaaaattgctctcttccggaatggtcacggtaacactgcttggtatctggagcatttgtatgatctgagcggaaatattcagcccgatctcacagatttgctgacttgccaggagaagaaaggcgaacacaaaggtgcgggtaaagaggagttttgggtcctcgccctcaaaaccgaggccggagaccatggagcgaacggcctggaatacaaggtttcccattaggagcgcccagccggcggcaatcagaatggaaggaatgtccttcgcaacaggagctacctgaaaaaaataatccaggtccatactgaacacagtcagcagggaatttgcaatgtactgcatcatttccaaacataggctgtaaatccattgcacaaaccctttgaagatattttcaaggatggtgaatccccccttcgggggactcccattcggcacgggcctccttccaaacgcaatcccccgttattgatttatacttttacgaagagaaagcaccggagacgggagatatagcgtgcgcttcaagtgttacagcgcacgccaccggtccgtgaggcccttttgacggacgcagcccgaacaaaccaatgcgccctgcgcgtctgcgaaaccgcagccggcacaggacacattttgatagtccgtattttcgttctccaggatgtcgtagacaatgcgcgctgccttcaaaccggaatctgtcgggctgaaataacactctgcgatgccgctggcatgaagctcattcagcagacgataaaattccctccagcgccaaaagcgttcttcactcagaaatacggcctgcgccatgctgcttggggcagaatccagatagccgaaatgaaattccaccctgccgtttctgttgattccaaaggagcaggtttgtccatttgcacgcaaaacctttaccgccccgccagactcggggatgtgcttgatttggaccggctccagccgtatctcgtcttccttcatctcataagcatcccagggggcgaagtacaaagtttgcccgaccgagagctgccctttgaggaatttgacccgtgcttttagacgggaatctggactcatttccagtattcaacccctctccgcaaaaatgttccggcatctacagctcggtaaaaccgtccgggaactctgctttgatgcgataataaactgactgggggcgtacccacagccgctggaacttgtgccactgttccgcctgcttcccgctggcgtcccggtaaagcatcgcaaagggccaaaaaccggcccggtaggtgtcaagcagccgtttttccgccgcgtccatcgtgtctccggggtagccgatcagcacatagcaggccgcccggtgtgaggtctgtgtgacgccttctgagcgcagcagccgtccggccgcaatcagcggctcatagtcatccggcgtgtcataggcaaaaaacatacgcttggccctggacgcctgaagcagttcgacatgccagggacgcagcaggcgggcttccagccccccggtaaaggccgggcgttcctgccgctgcatgagcatggcaaagaccgcccggatatgagcttctgaacatgccagaaggttgtcgtccagtacattccaccccgaggtgatggggagctcacgcagaacgccgccttcccgctttggtacagagcaaaaccagcatcggttggggcatccgcgtgatgtgattacatatccgtatttgagatagcggccggggacgaacgcaccgcctggctcacaaaaggccggaccgcccattcgcaccggaagccctgtggcggaccacatatccgccagccgctccgctttttgcatatcataggtgaaagttacggagatatggacctcgctgatgtccggcaattccccgcaaggcggcgggccggtaaaggcgtatgggtcttctggtgtagcggccgtccgtcttgggaataccctggtgatttttccgtgatttgacgccatatctgtcattgggtggacgtacctccgtccggatcaagggttgccagaccatcgaaaagaggctggacgtatgccaggaatgccccaatcccgtttatgacgatccagcaaagccagatccgtttgagccaatcccatgcctggtcggttttatgctggttattggacactttggctccgacaacggcgaccgccgacatcaatccggccagtacagtgctgatgcctgcaatttttgtgtagacatccttgatgatgcggtctgcggcctcccacatgtcctctgctgcggccgctgagatggtcatactgaacagaagaatcacgataagcatgatctgcatatagtagcgtgggagcttaggccccaaacgctcgaaatatatcttcaaaaagaccactccaatctgaaatattatgtttccgttacagaatcagcggacagggattgccggcagtttgattcgccgtattttcataaaaggcatcaatgtcccccatagcgtcatagggcagatgaagccaaacaatcgtcaacacatccagaggatatgtccacgacgctgcctggcggacttgcctgagcatctgctccgcaccgtaatttgcggcgggcgggacgtaggagcggccggccgcatccatatacaccaaatgttcatctttggaaataaaacgccctcccagcaatgacgcataggaaaacgccgcttggcgcagctcattgtttccgtagaaatccgcgtatcgcacaaaagctctcctcctgttcgtatgggaaagcggtgggacggcccgcaggccgtcccaccagttcactttattgcgtcaataaccagttttgggcagtgtcggctcattcagtctaacgatcagagtgatccacgcagcccgtccggtttcccactggctcatgtactggccgccggcatcgacccggttgaccacctgatagccattggctaggctggcgctggcctgcacagtgacagtgggcttcactaccgaggcaaatccagccgggacttttccgaattccagacgcacatccgtgactacctcgccctgcatcagctggacagccgataaatcgaaggcgtagttgttggtactgagtaggttggttgccagtacacggtaatcgttatagttggtcttataggtgatctggtagttgagtcgggtgttgtaagtgccggtcgtgatggtcttggctgtggagcagtccgtggggaattggtcgtggagatagaaattctccagcgccacattggagttgttggccaccgtgaggtcatagcgcatagagtccccggccaggagctgcttgttcccggttttggtgactgtgaccttcagattggccggcttgtcatagaccgcgattttgatgatctgccccgcatactccagcgtgacatcgtggacagtgggatcaagctggaaataggcgggtgcagtgacttcccggattttataacgcgtcaaaggcaggggcttggaggcagcaacaccccgggcgtccgtggtgatgtagtccaccacccggccgctgcgctcatggatgatttcatagatagctccctggaggggtgttcctgccggatcacctgtgacaggattggcttcagaggcgtacttgtaaatctggatctggccggtaatggcctcgttgacccactcaatttccgctgtgcggcctgggcgcacatagacggtcttatactcttcgtctaagatatagccttcagccgcttccagctccctcaagtaaaaccgtccgctggtattggcgccgtccggaaggtcgtcagaggtgatgtaaacatagccgttatcatcgctggtgaactcaccgatgggattgcggtcctcatcgtagagcaggaacttgacgccatagataccctcgccgctggtatccaccttatggatcaaaataccggaattggcctcattcttgatccgcagggtggtcacttctccgtttttgacctcgaaataatggggggtatcgtccagacggaagtcgggatttgcttcgatttcaactgcataataggagccgtcctccagggcaagataggccctgccgtttcggtctgtggtgatggtatctaccagggcatcatccatgcggcggatctcaaaggtggtatcaggaatccgttcagaggtcttgctcgcattgaccttgatgatctccacgccgcccacggcgttgttgtaaaaacggagggtctgcgtatcattggggttgatggtgacggtctggctctggctgtccgggtcgatggtgaatccaggtacgctctccagttccgttacgatgacggtgcccgtgacaccagacagcgtgatcttacccgaggagtcagaataatagatcccgttggaggacagggtgcctccggcagcgtccacaaactgcccattggcgtatttgatttcaaatttgacgcccttcagaggaaccgttgtgcttccggtgcgcccccacttttcgatcacgaggtttcccaggggcttgttgcggaactccaaggtcaccgtctgtccggccttgatttgggcagtctggggtgtgtcatccagaaggaaaccatcttttgcccgggtttctttgaccacaagtgtggtgccggggtcgatgccctcaatgaggatggtcccggcggaatcggtagtgaaatagccgttgctgtcgcccaccaccgtgccgtcgctctcggtcacaaagaactgaacatcagaaatcggagagttatcggcactggacacctttttgatgagcagcgagcccttgggactgttgccaaaatagacctgaacaacctcctgatcctcgccggagagatagaccgtctgaggcggggtgtcgatcacatgagagccatcactggagagctcttctatgatgtaagtgccggctttgcagcccgtgacggtgaaagagccattggccgaagtccggtaggtcccgatgacggtgccgccggtaccggaggtgttgccgctcaggtaacggacctggaacacagccccctcaatggcggctccagtctcactgtcatatttccacacggaaatagccgagagaggccggttgctgaagcggaacgtgtgcccctcgcctgcggcgataaacgcctcctgcgtgtccgggtccgccagagcaaagcccggcgccggctccagctcctttacccgaaaccagccatcacggagggagaggtccgggtcggagagcacgatacggccctcttcatcggtgtagaacacgcccaggtcgttgtactctccggtagcggtgttgttggatgcgtaccaaacctggaacggtacattttcgattcgatcatgtgtgattgaattttccttgataatctcgatggtggggcgcttataattttggaaatagacatcccgatcgcgattggggaacagcgtcaccagctgggactcctccgccagcaggtagggctccggaaccgacttttcgatgacctctacaacgccgggcagcaagttctccaccacggcgacaccggtctcatccgtttttacctcggcaatagaatggccgtcggcgcctttcaccagatagacggtcccggggatcggagccccggtgtccccatcggccttatggatatagagattggggcgcttgtcattggtcagggtaatggtgctggtctggccgggaaacagctccacatggtgctcggtatcatccgggatgtgatccagcaccgaggacaattcacgcacggaataaacgccaggctccaaaccggagatcaagatctcccccgtggaattggtggtgcggtccagatagtgagagccgtcctcaatcttggcgatccggaaggtgacgccagccagccgggagccgtcgctgctcagcttgatgagctggagagaggggttgatgtgattggtgaaaacgaactgggcatcttcattgggcttcagctcaatgatacgctgggcctcgtcgatcacatagccgtcgcaggatttttcagtcactacataggagccaggggggagcatggaaaggtcgatttctccattttcgtccgtccggaactcctggggtccataggtcccctccaccgatttgatctcgaatacagcgttggggatgaccttggaggggtcgtcggaatccaccttcaccagccgtaatccgggcttgacatcgttgaagaacaacagctccttaatgccgtctccggcgtggagctctacctcctggggggtggtgtccaaaatgtgcccctcatcgccggtatctacttcaaacgcccggtaagtgccgggctccacattggtgagcaaaatctcgccgaactggtccgtcttgaaattgcctaaaaatttgccgtcccgatagacggcgaaggtgacattgggcatggcgaccatattttttcgatcatacttgatgatccgcaatcccggtaattcctcgttgatgatagggattgtagtggtttcgccagcaaccaccgtggcggtgtagacggtatcatccagcttccagcctgccggcgctgtgatttcctggatacgatatgcccccagggggatctgatcgaaaatggcgactcccgcgctggtcgtcgtcgcagtccaggtctggccgctttcgatatgctcaattttgatgaccgcccccggcaggttcatgccagtgtcggattttttctcgatacgcagagtgccatagggatcattaaaaaatgtcacctcggctacttcatcgtagacgacagtgacattctgtgctggctcttcgctgatgatataatgggagggggcttggcgctcaattacggtataattccccactttactcagcggaatttcgatacggccatccccattggtcacaaaggtaccgatggagtcaccatccgggccgatgacctcgaacagtgccccactaattggaatctcggtgccggtctcatatttgaggattcgcaagccggtttcatactcgatggtcgtaccgtccgaatagttgctgtatgcggacagtcgcattgtggtcgtggggtcagtatctactacataattctggagttcgccgtattcatctttctcttggcatatcgcaaaaaatacggcgtatttataaacattcgtgctgaaagacagctgaacgctgccggtttctccctgcacgctttccagaggatacaataccttgaacttgccagcatagccgtcgcctgtacccttggtggtgatcgtggtaatgtcctgattgttcatgtccacaatgcgtgtgccctccgggacgagagatggatcagaaaaagacacatttaccgcataatcacatacccaagttttagaccagaaagtaaaaacctgttgcttgtactgctttccgtcaatggtgacctcataggcggtatcccgatctggagtgcagcttacctcaggggagagcatttcattccaggccgtaccacgggcataaatgtcctttgccgcagccaaaatcttctgcgctctttggagttctacgccggttagagtggggttgactttcaggttgttgatgtcccaatcgctgatgagatagcaccacagggccattttagtcgcgtagtagccctgatatttattttcgagcccaagttcctgcaagctccgggtcgggtatccgttggccacaattccaagcaccttcggatcgcttgccttctcgtccgccaggtactcgatgctttctccgacctcaacagtctgtggtacaccatattgattcgggtttacacagtacgctggaatttcgcggacctgaccacttccattatcaaaattataataggtgtagatctgggattgtatcttgccgttgatggacaggtaggacatcttcgtgccgccattatatatatcaatttcaccaagcgcttcatcaatgctggaggcggcggcggaggccgggaagagtcccagtgccataattaaggccagaagcatactaaaaaatctttttttcataggcaacctccataaaaatagggaggatgcctccatacgctgcatccccccttcgtgttgaatgggtagtgatttagttgtcgggatgcaaaaagaaagacagtgtaccatgtggcacgctgcctttcttataaactacccaaaatcagattacatgaatttgatattcagtgtgaagatatacaccatccttgtaaacatcccaagcttgcatagagtaagttccaggtggcacggaattgaacagattaacgatttcactcgctctccagggccaaaacatttgataggagagatcgtctggaatgctcaggttaatgtaaacagggaaaatccccttggcattcagcttaggggcaccgttttcccatgtcgccgggttatcgccaatggcgttgtagagggtgtagagcattctccgtgtctcatagagattgcggacacgaagatgattgccggtttcattttgccagtgccgcacctccatttccggaagttccggttgcgggagcaaactccagtcacaggtcggctctggcaggggaccgattgggccggaggcaaacatactcttgtcccaccggcttacatcggtaatggtataattggtgccgtcgttacagcggatcacatctccagcctgtggaacatagcgggacccatccgatgggatattgatcgagccatcggtattgtaagtgattccttggcggccggaagccgaactccctgtcccgtcctgcgggatattttcgcctgcttcccccgcggcggcatcgcctactccaatggagccgccctctgggctgcgcatcgcacggtagaggagaatggccatatcgcctctggtgacaacgcttttttccgccagctcgctcggagcaagaccgaggctgatcagcttatcacaagcagtgctgtagtcccacccgctggattctggatacccaagatgccgcaggattaccgtgcaggccgccgcaggcgtcaccagatctgcggcgccaaagctaccgtcgtcatatcccaccatcaggccattgaaggataggtatccgacatacaatctggcccactctggaacgtctgggaattcgcactttctggtgtagagctcccgctccgcttccagatgttccggattcactgtgatccgggtcagaatgaccgccagttctgtgcggctcaaagtctggtctaaggccatgtctccgttttggtcgccgaccataaccccctgttccgacacatagctggccgcggcccgcagttcatcgttttgagcggcagcccccgcgttgacgcacatgctcagggccaagcctgcgcacagtaccgcagaccaaacacgttttgctttcatttcaggctccctcctcataaagtgtcgtgcttgcgcttaaccgcagcaccttccgttcagcgtcatactggcaatcatcgaagctgtaaatgccccacagcgccagctgttccgctatattggaagggacatcgaacgtgagatccatgcgcagattgatcctgcctgtgtcgtccttttgacagccggattgacggaatgggaattcacagaccatgacaagcacctcgtttcctttttgtttgcagcgcctcttacagcctcacaataatacaggaaatccagcttgtcaaaggttttttattcggtaaaaggacgttatttcgcactttgggcaatcagtgcccaaattccatctttgcgcctcttttggggcaaaaacgaactcgaaaaaatgaatttgaattttttatgaactcacttcaatcccctggacacagacgcgcttgggtggctgatccgccagacatgtaatcaaagtgatccgattgtctgatgtggcgttcaaatagctccagtcagtccagtcgatgatccctacatagctgacggaataggtgcgggttcccaaacttgtctcatagcggatggcatcaccgacctccagatttttaatagagccgatattatggctggagccccgattgtgtccacacaaaccaatgttcccgctccatgcgctcgtgctggggaagtgccccacacctttccgcatggacgcggaggatgttccatcatagacccggtaacggatgcccaggcttgggattgaaagagtgcctatgctgccgtttgcctgctctacgtcgctgacaggggtaaaggccgtcaccggggtaacagacggtcctccccactgaagcgggtaatcattggaagtcccgtctggatagatgcttccggaagaactgccaatgccatactcgatggtgttccctgccaacggagaaggtgcgctgtcagccagagggtctaaaaaatccaccgcattctggccgccgtaattgtactgagcgccataaacctcctcatatgcggtgcttccataatagtcggccggggcttttgtttcaaaagagtaatcggcagccattgccggtgtgctgagcagcatacaccccatcagagcgagtgtgatgcgctggaacagtttcatagttcagatccctccttatcctcgtccttgaccgcaaaccaataattttctgtttcgttcccgtcaatgggctctaccagatgcgtacgcaccccatcataaaggcggatgctgatgagccgtccggccagcttccgggccagcttgtttttcaattccacgctggaatctcccgcggggtattctttcagcttggtaaagtccagctttggattgcgtacagctatgcgctgcctgcccagctttttatatgcaacaccttttgcgttcatcgcatagatggccgcatttggccggcgcagatatagaaaagccaggatagccgcaagcattgccaacccggccgccagcaaaaccagaagaggaagcccgatcgaaaatccggacttcagctgtgtccccagataggtcaccgtatattggacggagccaatcccttctgatgtgatctcgcccgtataggtggccgtggtgatatatccggttgccgcactccggcttccggtagcctggtaggttgcggtagctgtataggaagttggcaccagggtatcgtctgccagacctgtccctgtcaccgcccaggagatgttgctgagggacagcgtctttccgtcctttactgtggtagtcgggacataagacgggtcattcctggggagcccggtaaactgctttgtgtccgtaatggtgtaatacttggtggtatagccggccgcttctgtttgaagcgtagtgtggtccagggtaagcacaccagaatatccatccttgctgtattccatggtcggcgccagctgctccaggattgcggccagagaatcgctgctggtcgttacggtcacagtttccgtatgcgccttggaatcatggaatgtctggtcttcctttaccgtttccaaatgctcatagtggtagccctcaagatcaaacggctcgtcaaccagttcggatggatcatcctctgggctgagttggtaggtcttgatgatcagctgccggccatcccggttttctgtcacagagctttccgggatatatgccgcggaaactggtaggctcagcagacagagcagcgataaaaatacagccagcctcctcatgcgtgtttccaccaccttctgtacagagcgtagagcagcgctgggacagctgccgcggcacaggtcaggatcagtttctgcttcattttgtttttcctccattcacaaaaaattctatggacagctcctgataggagcatgagccatcacgcattcggtccagcaggctcagtgaggactccaaagcctgcatagtatcgcgccggtgctgcttgacaaatggggtcaaaaagagcacatcgccatctggcgtcatggtaaagatgatgcggaccagggtttttgacttggcgcgcagctcatagagactgctgtaccgttccagtgtgaaatgctttacatagggctcccgcatgacggaaactggggcctgaagcatgagcgcgaacagtgacaggagcttctgccgctgcttctcgttcagttcgtcattgaagaaatcatacaaaggcggcgttttatcactgggcattgcgatcatcagcttggacataactttcctcctcacgaaatacttcggtcagcgattccacaaaaccgattgagaatatctttaatgctttcggtgagcccatcagccaccaaacggggtctggcaggggctttctaagctggtcatactgcagcgacagaaaaaggtagatgcccttatagtcctttcgccctgacagttcatcaaaagaggccagcactgtgccaacagtcgattttgcatagctgtcacacaggttatagtagaattgagccgcataaatccttgtgaataagcgcatgttctctacgttgatttctccatctcttttgacgatccccatctgataaagcctgctgagcagtggaccatccatgggacgggcggtggagggcgttcctgctgctgtcattttgatccatcctttcgttgtaaaatgtgaaatgggcaaaaagaaagggctgatggcggatgaagccatcatgccctaacttcttatgcggatgatgtgttccttcctgactggaagtaaaaatcaagagctttttctagaatttcagagatttctttttgagacgcaccttccgaaaaatacttcccgcagcttctggggaggcggacagataccaggccccgatctggctttgccggtttctcgcaggccagcagttctaaaatacgctgttgatccagctttccttgttcaaactcttcccggagcagcttggccttccccttggacacggtcgcgccatgctgggaaattacttggtggatgcaggcttgcagggtggagttctcaataaagctgatttcataggcggccagctgcccaatctttttgctctcgtccagtaaaaggagcagtggacggtacagtgtggcaagacggcagtacttggagattttatctctcgtcagttcgtactcctcggccacctttgcgtccgtgtgcaacttctcctgacagtcaggagaagttgcgtcatcgtcctccactcttgccacgaggagatctgtccgccggccctgctgcttcataacattgtaatgggccgccacacacagcactcgctgggaaaagcgcagatcggacaacgacctctgctgaaaattcatttcaaagaacagatcttccgccatcttgggcgttagatctgtgcggatgactgcggagactgtggtgagtccagcgagctttgacgcgttgacccggttatgtccactgatgatgatgtgccggccatctgttgttttccagaccaaaataggcgtttgcacaccgtgcttttggatgctggagatcataccagacaggcgagccccggtatagagggggaaatgttcctcgtgatttggatacccctccaaaagctccagtggaaggacctctgtgatggaggtactggtttcaggctgttctccgggcttgacagggaaattgatcatatcggcaaatgtctggaactggatttttggctgtccatccttaacccgcatctcccatcagctccttcaaaaaatcttcgtatgcgacagccgcaggatttttaggccggtattcacaaatcgtctgctgatagccgctggcctccgccaccttaacggaacgggggatccgagtgttaaaaatccgaatttgattcccgattgtccgctccagttcctgggtgatctgagtggaaagattggtatttccctgattcatagtaatcaggattccggcaatctccagctttggatttgcatgttgacgaatttgctggaaattccggataaatttcatgctgccaatagcagagtagtactccgcctgggtcgggattacaacgctgtcagcacacaccatgacgttcagcatgctggtatcaaagtttggcatacagtcaatgatgatgtaatcatagctcggtgagatctggctgatgtactctttcaagatatattcacggaaatccacgttgctcaaattgcgctccagagtagaaatttcctcattggagggcaccaggtctacgccgtggtaggagtacatatagctggatggactcggaagcggctctccaatgatgacctgcttcacaagggacagaatggtagtttggagcttatctgggtttggcaccccgtaggccagggaagaatccccctggctgtctaagtcaatcagggcggtacgtttgccgcaccgggccagcagataggccagtgtagtggctgtagtcgttttcccgcagccgccttttttattataaacagcgataactttcgccacaaaaagcaccccttttcacaatcatacagtatcgttcacctgacggtgtacgacaacttcaggcttattcgagatgggcgctgggcccgcgtgtaatggcggcaagtctaacaggtttctaacagtcctcgtttttttcgcaaaatcccgttgtcttacaggcggaagttgtttccatccagagccttgtcagtggccctttttcccagtaaaatcaatgggtagaagggtgtcgatacgataatggaatcggcctactaacatatctgggctgtaaatggcattcaagaggtcagcggttcgatcccgcttatctccaccaagagacttgcttttataaggcaagtctctttttttgctaaaaagggaggcgttcgtgtatacgcctcccttttggtgaaattattttctatgtatagggttctggaactgtgtctcacttcgttgcaaagcagttcataaaaaattctgtaaatgccgccagttccttctcctgagacacatagacatacaatgtttcgtcctccaaccagtcataggcgtggatgccaatatagcttttcttatcaggatagataatgaatgcgtcagtgggatatttatttcgatatgccttcaaaatttcggagcggcggtaatagaccggctcgccgcagccggaaagatccgggaccgtaggaacgactacaattgtctgactctcctcattccaaccgaccagcagattcccaatctttgttttactcccgtggacgaacccatagttgaaccggcttacatcctcggtataaccaaatatcaacctgtaatcctccccgccccctactgcttggtgaaacagcgcacgcattttctttgcatttgcatcgctcttttccatatcaatttccggtcccttgaacagtttgctaaaaaaccccattgcatactcctcctaaacatatatcatataaagaacactcaaataaggattaaatttataatttatctttatctatagcagacttaaatccgcccgaatttgacatcgtacttcaatattcggacggattttccaattccatcagtcctgctctttcaatatctccaaggcatctgcgatcgcgttgatctgaaactccaccgtttcatcggcggcctccggcacaaacagcggaagcgtgtccgggatcgccctgcgtatgaccattaccgtgaggctcagattggtaaacaggctgatatttgcccgattcgccctgattccaaaactctccagtatggttccaaacaggcgggcctgcttttcgcggaacatctgataactctctttggacaggcgcttaaaaatgagctgctgctcctcgatggtcagaaccgcgatcccattcttctcgccatagcagcaggcatggaggaattgcctcaccccatcacgccagctcagagcaggatctgccatcagctttcgcgcatatgccacaattttgggctgctggaggtacagcgtctccacgatcagatcctccttggtcgggaaaaaggagtagaaaaacgtgcgtgatatcccaacccttctgtaaatctgctcaacggttgtatgctgaatcccctgctttgtcatcagatcgagtccgacccgaaccaatgccacccggatacgctcccgttcctcctccgaataagcgaccctaggcatcccgtccacccccaataaagacaaattaaatggtttatttttattttaacacactgggagtccgttctcaagagtcttttgggcctttgtccgttcggttgggccactttccacagcaaatccccttttctgttgcaattacaacatacattccaccgcgcctccgctatacttgcggacagttccaatacttccgcccgtacaaggaggactttacatgttttgttatcagtgtcaggagaccgctggctgcaccggctgcacccgggcgggcgtctgcggcaagagcgcccgcaccgccgcgctccaggatttgctcgtctatgtgacccggggtctctgccagctcacgaccgccctgcggaaccagggcgaggccatcatcccagaggacgaccggctggtgaccgaaaacctgtttgtaaccatcaccaacgccaactttgatgatgacgcacttcaggcccgcatccgcgccactctggagcggaatgccgccctgcgctcccggctggacggggcggggctgtccgccgccgcgcgctgggacggctccggcgactgggacgacaaggcccaggcggtcggtgttctgtccaccgccgacgaggacatccgctctctgcgggagcttatcacctacgggctcaagggcatggccgcctacaatcaccacgtcaacgcctacggcaagtccgcccccggcgtggacgcctttctccaggcggccctggccaagaccctggacgactccctcaccgcggaggagctgaccgccctcgccctggagaccggcaagtacggtgtggacgtgatggccgccctggacgaggccaacaccagcgcctacggccacccggaggtgacccgggtgaacctgggcgtgcgggataaccccgccattctggtctccggccacgacctccacgacctggagcagcttctggagcagactgtggggaccggcgtggacgtttacacccatggcgagatgctacccgcccactactaccccgcctttcagaagtatcccaactttgtgggcaactacggcaacgcctggtggcagcagaaggaggagttcgaggccttccgcggccccatcctgctgaccaccaactgtctggtgcccccgaaggacagctacaagaaccggctctataccaccggggcagtgggctttcccggctgcccccacatcggggccgaccgccagggacacaaggatttttccgccctgatcgcccacgccaggcgctgcccctcccccattgagctggaacagggcaccctggtgggcggctttgcccacaaccaggtgctggctctggccgaccaggtggtggaagccgtcaagagcggtgccatccgcaagttcgtggtcatggctggctgcgacggccgggccaagagccgcgattactacaccgagttcgccaaggccctgccccaggacacggtaatcctcaccgccggatgcgccaagtacaagtataacaagctggagctgggcaacatcaacggcatcccccgggtgctggacgcgggccagtgcaacgactcctactccctggctgtcatcgccctcaagctccaggagatcttcggcctggacgacatcaatgacctgcccatcgtctataacatcgcctggtatgagcagaaggcggtgattgtcctgctggccctgctccacctgggcgtgaaaaacatccacctgggccccaccctgcctgcctttctctcccccaacgtggccaaggtgctgacagataccttcggcatcgccggcatcggcactgtggaggaggatctgaaccgctttttcggctgatctccctcctgcggcggataccactctggtatccgccgcagcttgtcgaaaaagtcttttcgccaagctgctggatttttgagcacttcaaaaaagtgctcaaaaatcgtttgattgaacgtgaaagacaaccctgacggttttctttcacactatctttccctccgaatccttccgttggagggtttatcgacagtctgcggcggatacctgcccggtatccgccgtccttatgcttgacaatatcgtccttcgatattacaatatccatagacgatatcgaagcgcgatatcaggaggcgaggcgatgggacgcaaaatcctggagaccctgacggagtccatgttctatgtactgatggccctgttgcggcaggcgcggtgcggcacggagatcgccgacttcgtcgccgcccgaaccaaaagccgggtgcggctggggccgggcaccctctacaccatcctggccaaattcgaggaggtagggctgatccgggagaccgccgtggagggccgcaagcgcacctacgtcctcacggacgagggccgggcccgctacgaggaagagcttgtccgcctgcggagctgtctggcggacgcggaggaggagaggagggcgatggactatgaaaccgaggacggtgcgcagactgtgcctggttgacgggatgaacctggatcacatcgagggctggctggagtccatggccgcccggggcctacactacgaccacagtgacgccttcctctttcacttccggcggggggaaccggcggcggtacgctaccggctggaaccccgtggtaccctggactgcccggagggtatggagcactgccgcaccctgggatgggagctgaccggatacatgggcaaaggcttttccctgttcagaacctgggaaccagacgccccggagctgcacaccgacccggtggtacgggggtacgggctggacaagctggcaaggctggttcggtggttcgccacccccatgctaatctgcgccctggtcattcttgccctccccctatggctccttttggcctgggatgagccggtactgtccctggtcaccggaagcggggacaacctttttctctgtatcctgtccgagtggatcgccatttatatgtccttccgctccttctcctccttcttcgcccttcggcggcggctgcaggccggaaaggaaccccggcgctccggctggcggtgttccgcccgcatcaacgccgcctgtctggccggctcctttatcttggtggccctcagctttgccgtcctggcagccgggcgtggcatgcgctgggagggggagactgcgaccgtgaaccgccccttccccgacttcgccctggaggagctggaggggcggcccaggcttgaggccgccccctccgtctggtcggtggagcggcggggggtggacttggacaactatgtccgcttcgactggtctgtcctggccccggaacagtatgaggtggaacggaacatggcggacggatactacgagaccagtttccggctggattggtaccgtctctccctccccgccctagcggagccttttgcacgggatctcttttcccggcacaccttctatgccgaaatcccggagcggtacaccgtcgcgcccctggacgtgccggacaccgacgcagttctgatcaccgaggagggcggcttcggacaggacgtccttctgtgccgggggactgtggtgttctatctgcgctactatggggatcaagagctgtccgcccaccccgagctgctggccgagctggcccaatttgacgggaggtgagtccatggcgcaccataacaccgtccggcggtatccgccggtggactactatgatgtggtggcggtggatcgctggctggagcggatggccctcaacctccacgacggcccctatgcggcctgtctgctctacgacgggtcgggagaactgggccgcttttccgcccgctccgcccggtggtctcttggggattagaacatgtgtttgacttctctcgtcccttcccttataatggagctgcaaggaggcggacggtatggaccgggtgattctgcactgtgatctgaacagcttttacgcctcggtggaactgctggaccacccggagctccgggacagaccggtggcggtgtgcggcgatccaaattcccgccacgggatcatcctggccaagaacgagcccgccaagcggtacaaggtgcagaccgccgagaccatctggcaggcccggcgcaagtgcccggagctggtgctcctccccgcccaccactggaagtaccgggactactccaggcgggtcaacgcggtgtacgagcggtacaccgacctggtggagcccttctccatcgacgagagctggctggatataaccggctccctccacctcttcggcggagacgccaaggccctggccgacgagatccgccgggtgctgcgggaggagctgggcctgacggtatcggtgggggtatccttcaacaagatcttcgccaagatgggcagcgactacaaaaagccggacgccaccacggtgatttcccgggagaactaccaggagctgctctggcccctgcccatcacctccctgctctttgtggggcggtcggccgccgccgcgctggagcactacggcgtgcacaccatcggggatctggcccgcctcgaccgggaagccgctgcctccatcctgggcaggcagggctgcaccctccacgactacgctactggggcggagcattcccccgtggtgcccgcccgggagcagcccggccccaaatcggtgggcaacggcctcacgttcccccgcaatctggtgggctgggcggagctccacgccggagtcaccgagctggccgacgaggtggctgtccgcctgcggggccacggcctcaagtgcaccaccctccaggtaaccatccgtgaccccaatttcaaggacatctgccgccaaaagcggctgagcgcccccacctatgtggcccgtgagctgtcggaggtggctatggagctcatccgcgccgcctggagggagaacgcccccgtgcgcgccctcaccctcaccgcccaggccctggtggaggagggcgaggcgggcgagcagctcgatctgttcgccgccggcgccgccccccgccgggacaagctggagaagctggaaaaggccatggacggcatacgggacaaattcggccgggatgccatcgctccggcctccaccgtccaccgggacagggccgaagtcaaagcggagcagcgcctgcccccggtggactgaatatctggatgccgcgcggagcagcgcctgcccccggtggactgaatatctggatgccgcccggcagaggaggattcatcatgatcaaggccatcttttttgatgtggacggaaccctgctctcccaccggaccggccggatttctccgcacacaagggcttgtattcgcgcgctgcgtgccggtggaaccctggtgtttctgtccaccggcaggcacattctggagctgcggagcctcccagtgggggagatggcgtttgatggctatatcaccctgaatggtcagctctgcctggacagcagccaacggcagctctccggtactccgctgccgccgcaagccgtgcaggcgctggcagacctattctgtgcggatggcccgcccctcgccctggtggaggaggaacgcatctacattaaccgcgtcaccgacgccgtccggcaggcgcaggcggaaatctccacccctgtcccggaggtcgccccctataccggccgaccggtctatcaggccacggccttttgctccagaaaagaggacccccttctgagggctctgctccccacgggctgcaagctggcgagatggagtgagggcggcgtagacatcatccccgaggccggaggaaaggcggctggcatgcggcgctttctcacgcgcttcggtctctcgcggctggaatgcatggcgtttggcgatgcggaaaacgacctcgacatgctggcttacgcgggaattggagttgccatgggcaacgcctcggaagcggtaaagcatgccgcagattatgtcacggcaagtgtggacgaaaaagggattgaacaggcgctgcgccattttcggctcatctgaaaaagcgccgggactgccgatacctctttactggttcaaagccaggttcaaatgtaaaataagtcttgtctaaaagtcctcctgctgtcatgaaaccggaaatttaaacagccagagccagcggccctttttggcgcgtcagctctggctgtttcctctttcctatggttcttatgaatgcgctgaatcgctcttgtctctgttgcccttttgctgggataccctttcacggacgtattttttgagcttccgccccgccacaggccacgccagggccaaggccagaacaaccaagctgagccactgagacgtggagaagggcccgtacatcccccgggccggatccccccgaaaccactccaacacaaaccgcaccggggcatagcagaacacataggcccggagcatctgccccggcccggcggcccgcccggcataccagagcagaaaggcgaaaatcaccagctccgcccccgcctcccaaagctgcaccggaagaaggggcacgccgttgggcccggcaatggcgtgagtgaatgctatgccccaggggggcggagccgcccgtccatagcagcagccggcgcaaaaacagcctacccgccccacggcgtgcaccagaggcagggcgggcaccagcaccgggaagaagtcggacaggcggagccttaaatatttggccgccccccaggccgccgccacaccgccgaaaaagccgccgtaaaacaccatgccgccggagagatagcgggcatagaactcccctggctcctcccagagcaggggcagctccacagccagccggggcaggagggggagcaggtagagcagcttggcccccaccagggcccccaccgcccccaaaatatacaggtaggcgcagtcgtcccgggacagtccgaagcgcttgcagcgcagcagagcagccagcaggccgaagcccagtccggccatccccagcacgccataggtgggcatcaaccgcccaaagagagacagatatgggagcatgatcgcatctttcctccaaaaaatgcggcagccacaccggctgccgcatttcgtttccccttcttagtacagagaggcgcccagaatacccaaaccagccgtacaggcaatgcaggccaccagggtaatgccgcccagaactaccgacaggacagagagcacaaagccggccgtccgcaagctgtcgttatagcccatgctcttggagcgcgaggacacaacaaggcctgcgataccaagaatcatgccgaaaataccgttgacgaacagggcgaccaccaggcccacaatacccagaatcagggagatcagagcctcattttttccagggatattaccttcattcatcgtgccgttctcctttcctccacacaccgctcttctgcgcccggcctgccgggcgcaaaagcgggatatcccgcttttcgacgtgtttcgttctctctcctattctaacttccgcgctgtggatctgtcaagcacatctttcagagatggaaccttctgcgcgcctcctcccggagggcggggacgcggcgaataatgatgagcggaatcaccatgccgatgcagatggtgagcaccaccaaggaccaggacggactccaaagctggtgcagccagcggtccacaaaaaactccattccaaacacaaagacgccgatgctgccgatcaggatcgtcatcgtagtaagggccgaccggcggtagacccgcagcaccagacccaacagaagcagaatcgccccgccccacaggatgattggggcggccaggcccagataccagtctctcccattgagatccacggagatcaggtagacgtacagcgccaccgccgccacgtccagcaacagccgcagcagcaggtgcatcccccgggccagcagcggcggcaccagccacagccacagcatggccgccgcgccgatgacgtacagcgaccacatccggtccgcccgcaggaacagattgagtacgccgcagcacaccgccaccgaggcgagcatggcggtaatgagcagcgccacctcctgtttggccgccggcgccacctccccccgccgggtgggaaaaggcttgggggaggcggtatccaccggttggccggggtccagaacccgcgtatggcacagagggcagaaggacgccgtggcgtccagctccacgccgcaatgaacacagtaagacatatgtgggcctcctttggcttattccgtccggttgctctccaccttcaccggaatgccctcccgcaccagaaagcggaaaaaatcccgctcggtatcgctctccttttgggtacccgcgaaggtgatctccatgatatccccatagctcatggaggcacagtggggccggggcgtggtggcctggcccagaatcacctccatatggtgtatgtgcggagccatctcctccggcacggggaaggggcctgggttggtataggtgcccgagtaaggcagtacacccgccagcttgtagcccagggacatgaccggattcttcagcacgatggggacgagctgcagcagccggtttgtggtgaatttcacattcccggcgatggccgcctgcatctgttggcggttgatgttcagccggagatagtggtgcacctgagagagcacctcttcaaaggtatactcccccagagaggggtcgatggagggccgcaccgtcaaaatgaagttgcgcagggtttccgagggaaaccagccccgcaggttgataggtatggccagcgccaccggcctctcccgccgggggcgctcccggtgctgcttgtcggcgatcaccttcagcaggacggcagtcaggtattccgtgatggacaccccgtagcccctggccttttccttcagccgggccaccgagcagaagcccatggtgacgttgaaggtatagaagggctctgccgtaccgttgttctggtaggcctttttcccccgcttctcccgccggggacgcacggtggcgtagcggccgtaggcgtcctcccgttccgcccgccggggctcctccgccacgtccagaatgccgtgggtgtttgggatggaataccccagctcccgcaggtagaccgccagcagagtcttgaaaaataccagcgccccgccgccgtcactgacggcgtggaacacctccacggagatgcgcttctcataatagtaaaagcgtaccagccagccgttgtcctcccggaagcgcaccggctggcaggggttggagatatcctccttcacaaagggcccgggggcgctgtttggctcgaagtagtaccagaaagcccccttcttgatgcgcaccccgaaggacgggaaccgtggcatggttttgtccacggcccgctgcaaggcatcccggtccacccgctccgccatcacggcagagaagcggtagatggccgaatatttctccttctggagggcggaatagagcacacccgcattgtccaggggataccactccggcttttcgccccgcttgtccctcggcatactccgccccccttccggtcaacataatctaggcctatcataccacgttccatcctccgcggcaaggggaatacgggcgatccaccctttcttttccggcagccctgtggtataatcagaacagttgacaaggaggacttccactatggaacaggaccgtatccacatcaagctggcccgccgcacaccggaagagcgccaggccgacgagacccgccgcctggaccccttcatgcgcgccctcaaggccattcacaccgccgccacgccggagaccatgaatgtggaggatctggagaagcagcgcaaggggcaggagctgctgggccgtttggtggcccccatggcgggcatgagctgggagccctttgagctggacggcatgaactgcgcctgggtgcgtccccaccggggccacgaccgccgccgggccatcctctactgccacgggggcggctataccagcggcaacctgggctattcccgtattctggcctccaagctggccaacgtcaccggctggcaggtgctctccttcgagtaccgcctcgccccggagcacccctatcccgccgcggtggaggacgccgtgaaggcctgggactacctgatgtaccagggctacggcgcccgggacgtggtggtggccggcgactccgccggcggaaacctggccctggtgctcacccacctgctcaaagaggccggacggcggctaccccgggccctcattctcctctccccgtggacagatatgaccgccagcggcaagtcctaccaggagcgggccgccatcgacccggtgctcacggtcaactatattcacgccgttcgggacgcctacgcccgggaccaggactggtccgacttccggctctcccccctgttcggcgatttgaaggactttccccccaccctcatccaggcgggaagcagcgagctgctgctttccgactccatccgcctgcgggaccggctggtgcaggccgcggtgccttgccggctggaggtgtggacggatctctggcatgtattccagatgttccccatgaaaaaggccaccgaggccatggagagcatcgggcgtttccttttggagacactataaaagaaacgaggtttttgctatggcaattctagtgaccggcggcgccgggtatatcggcagccactgcgtggccgccctgatcgagcggggggccgacgtggtggtggtggacgacctgtccaagggccaccgggaggccctcaagggcggccgcctctatgtgggcagcgtagccgaccgggccttcctggacgatgtattttccagggagcccatcgaggcggtcatccacttcgccgccttctccctggtgggagagagtatgcaggtgcccgaacagtatttccgcaacaacgtcactgccgggctgaccctcatcgagaccatgctggcccacaaggtgccctatctggtcttctcctccactgccgccaccttcggcgagccggagtatgtgcccatcgacgaggcccaccctcagaaccccaccaacccctacggcgagagcaagctcatcgtggagaagatgctcaagtggtgcgacctggcccacggcctcaagttctgcgccctgcgctacttcaacgtggccggagcctggcacgacggctccatcggcgaggatcaccggccggagagccacctgatccccctcatcctccaggtggcccagggcaagcgggagcagctctccctcttcggcaccgactaccccaccaaggacggcacctgtatccgggactacatccacgtggaggatctcatcgacgcccacttcctggccctggactacctgaagcgcaccaacacctccgccgccttcaacctgggcaacgggcagggcttctccaaccgggagatcatcgaggccgcccgccgggtcaccggccaccccatccccgtccgggaggagggccgccgccccggcgaccccgccacactgatcgcctccagccggaaggccacggaggtgctgggctggcagcccaagtacaccaatgtggaggacatcatcgcctccgcctggaagtggcactcctcccaccccgacggctacggcggttaaccctaaaccggcggcggacacaactccgccgccggtttgttgtatccagaaggccactggcccagccagtggccttctggatacaacaagcgccgtcccggccgggacggcgcttgcttgttatctctttcggccggagagcagcaggcccagaacgacgcccaccccggcagggagcacccagcccaggcctacgtccgccaggggcagggcgtccagaaagtccagaggcaccttcagacccttcagggcaaagagtacgctgaacactccagtgcacagtaccgccgcaggatacacccagcggcggccctccagccaccgctggaagaaggacagggcgatgagcacgatagccaccgggtagatggcgctgagcaccggcgcggacacttccaggatttgggccaagccagcattggagatggccatgctcaccaaagcgaagagcaccgcccacccccggtagctcagccggggacagatgctgtggaagtactcgccgcaggagctgataaggcccacgcacacattgaagcaggcaatgaggaagatacccgccagcaggacgctgcccacggtgccgaacagcaggcccaccacattggtgagggcctccgccccgtcggccgggttggggagtgcgccgccagacagagcgccgatgtgggccagcatgcagtagaccgccagcaacatccctccggcgaccacccccgcccggacggtaccctgcaccacggcgccctcctcctccaccccccgggcgcggatgttcaccgcaatgacaatgccgaaggccagggcggcgatggtgtccatggtctgatagccctcgatgaagcccttgaccaccgcatgggtcgcgtagtccccggtggccggaccgtagccctccagcgggttgaccagacagcccacaaaggtgacgacaatcagcgccaccaggatggggcagagaatcttgcccagccggtcggtgagcttctccggccgcagggcgatgaacagggcggcggcgaagaacaccagggagtagaccagttgatacaccccgatgggggcgtccgctcccacgaagggagggacggccatttcaaaagaggtggtggccgtccgggggatggccaggcaggggccgatggccagataggccacgatggtgaacacccgggcaaaggcgggatgcacacggctgcccagggcatccagcccgccggagcgggccaccgccaccacccccagtaccggcagccccaccgcgctgagggccagccccagcatggcgggccaggtttgggtgcccgcctgggccgcaatattgggcggaaaaatcagattgcccgccccaaaaaacatggagaacagggtgaagcccaccagaagcagatccctgccctccagccgtctctctttctctctcacggtcgtttcctttcccgcaatttaaaaacagcggcataccgcacggcatgccgctgtttttcacttacgtaccaaaatcagccctgggagatggcacccgtggggcaggtatcggcgcaagaaccgcagtcgatgcaggaaccggcatcgatgacgtagtgctcgtcgccctgggagatcgcgcccacggggcagttgccctcacaggcaccgcaactcacgcaagcgtcgctgatgacataggccattggatacacctccaaacactcaagctaaagtcattgtaccataactttttaaaaatgcaatgctaaaatgcgccgactgtgggtatattttttcacagtgggaaaaaatagaatccagccacccgaaggaggcgtatttttccatggacaaatcctctcaatttcacatggaggcggccgggagcctaaccccggagctggacggcgcgccgcgcagcggtctgcaccagcacagaacaaaagaaaaggggcgtggcacagcggatgaagcccgtcaaaaggcagtggaggctcctcttttggagacggagcaaacgaggtgaacacatgagcgaaaccagatttaccgagcgggcccaggccgccctgcggctggcccaggagtgttcggccgagctgggccacggctatgtgggcagcgagcacctgctgctgggcctggcccgtgagggcaaaggggtggccgccaaggtgctccagtccgccgggctggagccagagagcctgaaggccgccatcgcccgcatggtgggggtgggcgcccccggcggcgcgccgtcccaggggctcaccccccggtgcaaaaagatcatcgagctctccctcaccgaggccgcccggctgggccaccactacgtgggtaccgagcacctgctgctgggtatcctccgcgagggggacggggtggcggtgcgggtgctctccggcaccggcgtggagccccggcggctccacgccgacgtggtggccgccatggggggcgaggcctccccctcccccttccggggcggcggcaagacacgggagcgggagtacggcggcgacacaaagctgctggaccagttctcccgcgatctcacccggctggccgccgggggcatgctggacccggtggtgggccgggacagggagatcaaccgggtcatccagatcctctcccgccgccagaagaacaatcccgccctcatcggcgaacccggcgtgggcaagaccgccgtggccgaggggctggcccgccggatggtggcgggggatgtgcccgacgagctgcgctccaagcgtctgctttccctggacctgtcctccatggtggcgggcaccaagtaccggggcgagtttgaggagcgggtcaagaacatcctggcggaggtgcgccgggtaggtggcatcatcctcttcatcgacgaactgcacaccattgtgggcgccggctccgccgagggggccatcgacgcggccaacatcatcaagcccgccctgggccggggcgagctgcaggtcatcggcgccaccaccaccgacgagtaccgcaagtatatcgagaaggacgccgccctggagcggcgctttcagcccgttctggtacccgaacccgatcaggacaccgcccgggccatcctccggggcctgcgggaccgctatgaggcccaccaccgcctccagatcaccgacgagtccattgacgccgccgtggccctctccacccggtacatcggggaccgccacctgccggacaaggccatcgacctcatcgacgaggcctgctcccgggtacggatggagcggctggccaccccgccggacctgcgggagctggaggagaaggtggagcacacccgccgcgagaaggaggaggccatccggggccaggactttgagaaagccgccatgctgcgggacgcggaggaggacttccgcaaggagctggagcagcagaagaccgcctggcgctccggccagaacaccggcgcggtgaccgccgaggacgtggccgccgtggtgtcgggatggacaggagtccccgtcaccaccctcaccgaggcggaaagcgcccggctgctcggcctggaggaggccctccaccgccgggtggtgggccaggaggaggcggtacgggccgttgcccgagccgtccgccggggccgggtgggactcaaggagccggggcggcccacgggctgcttcctctttctgggccccaccggcgtaggcaagactgagctgtgcaaggccctggccgccaccttatttggcagcgaggaggccctgctccgcttcgacatgtccgagtatatggaaaagcacgccgtctcccgcctcatcggctcaccgccgggctatgtgggccacgaggaggggggccagctcaccgaaaaggtgcggcggcggccctattgcgtggtgctctttgacgagatcgaaaaggcccacccggacatctggggcatcctgctccagatcatggaggacgggatggtgaccgacgcccagggccgcaaggcggatttcaaaaacgccatcgtggtgctcacctccaacgtgggggccgcgcgtatcaccgccaagggcagcaagctgggcttctccgctaccgagcggcgggacggcgagacccgccccatcgaggagctgaaggccgcggtgctggacgacctgaaaaaagtgtttcgcccggaatttcttaaccgcctggacgagactatcgtttttacccagctcggccgcacggaaattcaggccatcgcccggcgcatgctggaacgtgtgggagagcgtatgaaggctctgggggtgacactccgcttcactgaccgggctctggagactctggccgaccagggctttgaccccgactacggtgcccggcccctccgccgcaccatccgcgcccaggtggaggacgtagccgccgagcagcttctcagcggcgcgctccaggctggggacacggcgctggtggacggcgcggaaaacggcctgcgtttgtatgcccagcccgccggaacccaggccctcaacacaaaggagaacgaactatgaaattgcagcgcacactccccctgctgctgctcctggccctgctggccgggtgcggtacgtccagccagccgagcgccctcaccgccgaggagcgcacccagctctaccagaccgccattgagagcgcccgggacgccgagatgaacgaagccattggtatcctcaccgataccggggacgacatggccgacgtgatctttgagctgctgggggtcacagccgccgacatgagcgccttcgccctgtcggtctcccccatgaatatcaaggcctacggcatcgccgccatctaccccgccgctgggaagtcggacgccgtactggagggtctcaacgccttcatcgaccggcagaagcagagctttgagcagtatctggcggatcagtatgaaatcgccagcaacgcccgtctggagactctggaggacggcaccatcctgctggttatgtgcgaggaccaggacgcggtgtttgacgccatccgagacacgatcgagggcgcagcctgaaccaaaaagtcgtttgattcaacccgaaagggaaccctggcggttccctttcacactatccttccctccgaagcctttggcaggagagttttcgacagcctgacagctccgccaggcaggggttgcggcggccgcgccggtggattataatggagcatactacagtccgttccacattggaggttttggtatgcaagcgcgcgcaagcggtatcctgcttcccgtcttttccctgccggggccctatggcatcggcacccttggcgttcccgcccggagcttcatcgactttctggcccaggccgggcagaagttctggcagattctccccctggttcctcccggcggcggtgattccccctacatgtccccatcctctttcgcgggcaacccctttttcctggatctggaggagctgacccgggagggcctgctcactcaggaggagctggacgccgcccggcgggccgaccccgaccgggtggactatgcctggctgcaccagacccgcatccccttgctacggcgggcatgggaacgcggcagggtgcgctacgcccagccactggcggaatttatggcggaggaggcagactggctgcctgactacgccctgttcctcgccctgcgtgagcgctttggcggcaaggagctgaaggactggcccgacgggatccgcctgcgccatccgtcggccctggcccgttatcgggccgagctggcggacgagtgcgccttccacgccttcctccagctcctgttcttccgccagtggaccgccgtaaaagcctacgccaatggcaaggggatctccatcatcggcgatctgcccatctacgtctcccctgacagcgcggaggtgtggagccgcccagagctgttccagctcaaggaggacatgactccttccggtgtggcgggagttccacccgacgccttctccgacaaggggcagcactggggcaatcccctgtacgactgggactatcaccggcagaccggcttcgcttggtggcggcaccgggccgcccacctggcccggctgtacgacgtggtacgcatcgaccacttccgggccttccacacctactggtgcatccccgacggggcggccgacgcccggggcggccactgggagcccggccccggcatggagctggtgaaggccctgcgctccgtccccggcctggccttgatcgccgaggatctgggggatctggacgccgacgccctccgcttcatcgcagacagcggcctgcccggcatgaaggtgctggtctacgcctttgatcctgcgggcgagagcgcttacctcccccacaactgcccccgggacgcggtgatctacaccggcacccacgacacccccacctttgtccagtggctctttgagcaggccgcccccgccgagcgggactatgccttcgactacctgcgcctgcgggaggacgagggcttcggctggggcgcggtgtgcggggcgtggatgtccccctgtcgtctggccatcgcccccatgcaggatctgctgggcctgggtggcgacgcccgggtcaacaccccgggcacagccggcccccggaactggagctggcgggtacggcaggaggccctcaaccccagtgtgtccggccgcctggcccacatcacccgcacctaccgccgatagcataatccgcccgccgcaaaacccaggctttaagaaaagatgttttcttatctttcagcagagggagtatcttgaggtgctccctctgcatttttactccaggttgccgatgcagttaaaatagaaatcgacccaatccttttttcttccgcccttcggaacgctcatgcaccaggatgcgctccacgaactcatggagaatttccggcgtcaactcttgaatattcaggtaacgatccacgacctgcaagagctgatccactccctgaatgttttcctcctgatcctccagttccgtttccatctgtgggatgtgcgcttcacactcctcctgctctgcatggcacggaaccccttgtgctgctgagcgagatgttacacgatattcaagaggggcaccgctgtcttttttgcttcggaacatgttctatgatttcgcagtccaacagagtcgccaggcaagctgctcctcggctgtaacgacgattgggaagtatgccgcttcatgtggagtaatttgaagaaagaaactccggggcagctttgactgcctagtttcttatttttcggtccctgattctatctcactccaacccttgctgagatagtccgcagccgtaccgcggggatctgccgccctgcctgccggtaatccccccctcctcatctaagtacactcagcagatgccagggttccgcaaacagaatcgtctttttcacctctatttcatccgaccaaagcctctgtatctggtttagatgaagcccataactccagaacaacaatggtttgcatgtcataaacagtccgtggaccggcgcaaaaaacggcgccggtccacgcgctgtcatcccatggccgtgccgctgtaagaggcgcatggccaattttgttatgcttgtgcatagcaaaacaccccagtctgaagaatgacgattatttgttcagactgggtagggccgttcgaaatttagttgaaagtatttccactgttttgcaaagcctgcgcctcctataataaaaagtatcacttaagatggaggtcctctatgcaatcaggaaaaatatatggttacgcgcgcgtatcctccaaacatcaaaatgaagaacgccagcttattgcgctgcgggcctttggcatcagggacagggatatctactgcgacagacagtccggaaaggacttcgaccgccccaactatcaaaggctgctgctccggcttcaggctggcgatgtatttgtggtaaagagcattgaccgtctgggacgaaactacaacgaaattctgtaccagtggcgtctcctgaccaaggaaaagcaggtctttattgtcgtactggacatgccgctgctggatacccgcagcacacgagatctaactggtacactgattgcagacattgtgcttcaactgctctcttatgtagctcagacggaacgtgaatttattaagcaacgacaggccgaggggatagcggcagcgaaggagaggggggtacggtttggcgtaccccccaagacgcggccggaaaaatttgaacaaataaagcagtcctggcagtcaggaactctatccgcgcgggaggccgccaggcagttgggaatttgtcacaagacctttttgcgctgggtacgcagttaaatgcgagaaatcgtgaccgttaaagctatgctgcatattctacaaacaaaaaagtaatgaagcaaaaattttggttataaaggttgagattttgcaccggtcaaaatagggggaagaatgaacgcaaagccaccttaactattcatagttaaggctgcctggtcacaatcttgaagctccggtaaaacaaaagaaacagccgggttgtcaggcattacagcagggaaatacatctttcttttccgcccaagattgcggaattatctgggagcttggaaagcttctttattttagcaccaggtggggcataaagtcagctttatgccccacctttttatttatgtaaaagggcatatctgctccgtacacaaacggacagccgggtttgaaggaatttgcttgtgggaatacaggggcaaaatgaagagcagaaggagttgtatgcaatgagtggaaaagaacagtgggaagcagaaaccgtcgcaaaagcactgacgaagggcccggagagacgaaccgtctttgaaaccaccagcggcatcccggtagaacggctgtacacgccggaggatgctgcaggcggctatgaggagcggcttggctaccccgggcagtatccttttacccgcggaatccagcccaccatgtaccgcgggcgcttctggacgatgcggcagtatgccggctttgccacagcggaggagtccaacaagcggtaccgctatctgttggagcaggggcagacgggcctgtccatcgcctttgatctcccgacgcagatcggctatgactcggacgaccccatggcccatggcgaggtgggtaaggtaggagtggccatcgactccctggcggatatggaggtgctgttccaggggattcccctggacaaggtaagctcctccatgaccatcaacgcccccgcggcagttctgctggccttctatattgcagccgccgagaagcagggagtgccggcctccgccctcaagggtactatccagaatgatatcctcaaggagtacgcagccagaggtacatacattttcccaccggcgccctccatgcgtctgatcacgaacacctttgaattctgctcccagaacgtgccgaagtggaacaccatttccatctccggctaccacatccgggaggccggctccacagcggcgcaggagatcgcctttaccctggccgacggcatcgcctatgtggaggccgcgctggaggccgggatggacatcgacgaatttgccggccggctctccttcttcttcaatgcacacaacaatctgctggaagaggtcgcgaaataccgggcggcccgccggctgtgggccaaaatcatgaaggagcgcttccatgccaaaaaggaccgctccatgatgctgcgcttccacacacagaccggcggctccacgcttacggcacagcagccggacaacaacattgtgcgcgtggccatccagacattggcggctgtgctggggggcacccagtccctgcacaccaacagccgcgatgaggcgctggccctcccgacggaggactccgtgcggatcgccctgcgcacccagcagattgttgcctatgaaagcggtgtggctgacagcattgatcccctgggcggcagctactatgtggagcgcatgaccgacgagctccaggccgcagccgaggcgtacatcgaaaagatcgacgccatgggcggagcggtcaaggccattgagcagggctacatccagcgagagatcgcggagagctcttaccagtatcagcgccaggtggagagcggcgagcagatcgtggtgggcgtcaacaagttcaccatcgaggagccgccggccaaggggctgctgcacattgacgcctcggtggcggccaaccagatcaagaagctgcaggagatgaaggcggcccgggacaacgtactggtgcgccagcggctggacgccctgcgcacggcggcggagggcagcgacaacctgatgccctatattctggactgcgccagggtgtactgcaccgaaggagaaatctgcggcgagctgcgcaaggtgttcggcgaataccgtccgatggaggtgctttgagatgagtgaaaagaagatccgggttctgattgccaagcccggcctggacggccatgaccgcggagccaaggtagtggcccgggcgctgcgtgacgccggctttgaggtgatttacaccggcctgcgccagaccccggagcagattgtggaggcggctgtgtccgaggacgtggacgcggtaggactctccctgctctccggggcccacaactatctgttcccacgggtgatcgagctgctgaaagagcaggaggctgacggtattttggtgttcggcggcggcgtcatcccggaagatgatattccagagctgaaaaaggccggtgtgtccgaggtctttacgcctggcacacccactgcggagacggtgaagttcctgcaggatcactgtggtgccagggatgacggatgactttgcagcactgctggagcggggccggacgggtgataaacgcgcggtggcccgcctgatcagcctcatcgaacagggtggggaaacggcgcgctccgtcctcacccaactctggccccacaccgggcgggcccgcatctttggcatcaccggtcccccaggggcgggcaagagcacgctgaccaacgccttgaccaagtgctggcgggccaagggcctgcgcgttggcatcatcgcggtggatcccacgagtccctttaccggcggcgccatcctgggcgaccgggtgcggatgggggatttgaccctggataccggggtgttcatccgctccatgggcacacggggacagctgggcggcctgtcgcccgccacggcgggagcggtccacgcactggacgcctgcggctatgacctgattttgctggaaaccgtaggtgtagggcagtccgaggtggcggtcatggagatcgccgacctggtgctggtgctgaatgtccccggattgggggacgatgtgcaggccattaaggccggtattctggagatcggcgacctgttcgcggtcaacaaggcggatcggcccggcgcggatcgaacggccaatgagctgcgggccatgctggagctgggagaggaggagaagcgcccgctgccagtgctcctggtctcggcctctcagggcacgggtgtgacggagctctgcgaggagctggagcgccagtacctcctcctggacgggaacggagagctggcccgccgccgcgccttgcgcctgcgcagcgagcttctgaccctggtgcgggagggcatcgagcagcgcctgctgcgtcccctgctggacagccccatgttcgctcagagcctggagcggttccagtccaggacagagagtccctatcgttgggcggaaaaatttgtaacacaaatcagtggaggaggtcccggttatgaattgcacaagagttgatcatgtcggtatcgcggtcaaggatctggcggcttcggtgaagtggtatgaggagacgctgggcctgcacagcaagggcacggaagttgtccaggagcagcaggtgactgttgcgttcctgccctgcggcgacagtgagctggagctgctggagagtacctccccggagggccccatcgcccgcttcattgagaagaacggcgagggcattcagcacatcgccatccgggtggacgacattgacgccgccctggcggagctgaaggaaaagggcgtccggctcattgaccagacgccgcggtacggcgccggcggggcccggatcgccttcctccaccccaaggctacccacggtgtcctgctggaattgtgtgaaaggaagtgaggacaatgactacggcggaaaagctggctcagcttgacgcgcattcggcccgtgtgctgcggtgcggcggccctaaagcggtggagaagcagcacgcgctggggaagcggacggcccgtgaacggattgaattgctgatggataccggcacttttacagaggtggaccgctttgtgcgccaccgctgtaccgccttcggtatgggggataaggacatcccggccgacggcgttgttaccggttacggcaagatcgacgggcgcacggtttttgtatacgctcaggactttaccgcccagggcgggtctctgggcgagatgcacgcggccaagatctgcaaaatcatggacatggctctggaggcgggctgccccgtggtgggcctgtgcgactccggcggcgcccgcattcaggaggcggtggacgccctgtccggctatgggcagattttctaccgcaacgcctgctcttccggacgtatcccgcagatctccgtcatcatgggtccctgcgcgggcggcgcggtctactcccccgccctgacggacctgattgtcatggtggaaaaggagagtcagatgtttatcaccggtcccgcggtggtagcggccaccacgggcgaggagatctctgcggaggatctgggcggagcggatacccataccactatgtctggagtggcacacctttccgcgcgcagcgaagaggaggccctgggagcggtccgatgcctgctcagctatctcccctccaaggcaggagctcggccccccctaatggattttaccgagcatgaggaattacagcctctgctggacacggtgattcccgacgactcctccctgccctatgacatgcacgatgttgtccgcatccttttagatgaagacagcgtaatggagttgcagccctattatgccgacaacattatcacctgcttcggccgcctgggcgggcacagcgtgggcgtaattgccaatcagcccttttctatgggcggaagcctggacatcaacgcttcagacaaggccgcccgcttcatccagctctgcgatgccttcggaattccgctgatcaacctggtggatgtaccgggcttcctgcccggcgccgaccaagagcacgccggcatcatccgccacggagccaagctgctctatgtctactcggtggcggaggtgcccaagctgaccgtggtgctgcgcaaggcctatggcggctcctatctggccatgtgctccaaggatttgggcgcggattttgtatacgcctggcccaccgcggagattgcggtcatgggcgcggccggcgcggccaacgtggtcttccgtaaagagatccaggcggcggaggatccgaaagcggcccgccgggaaaagattcagctctattccgagcagtttgccacgccatatatggcggcctcccgcggcttcgtggatctggtcatccgcccctcggagaccagggcgcggctgctggaggcgctggagctgctgatcaataaggagcggcagccccatccccgggggaatatgccgctgtaaggagttgaaacgagatatgggtattattccatacacagccatgacctacggtctgacagcggtgatttccctgctggtggtggccatcatcgtgggtatcagcaagctgaccagccgcccgggccagacggacgacggagagggggagccgtaacatggagttctttatgcagctgtttcccggcatcggaaccttctttgcggtggaacccgtaatcgcggtggcccgtattgtcctcattgtattcggctttgttttggcctgcctggggttcaagcggactctggagccgctgatcatggtgccgatgggaatcggcatgatggcggtgaactgcggcatgatgttccttacttccggaaccgtcggcaatctgctgctggacccgcttgtctccgatgcttcggctattgtggatgccatgcaggtcaattttctccagccaatctataatctgaccttttccaacggtctgattgcctgtctggtcttcatgggcatcggagcacggagcgagatcagctttttgctggcaaagccctggagctccatgattatcgccatttttgctgaaatgggaacctttgccgcgctggcggcgggcgtactggcctttgggctgacgccggagcagtctgccgctatggctacgatcggcggtgcggatggccccatggtactcttttcctctttgatgatggctcctgagctgtttgtgcccatctccatcattgcatatctgtacttaagcctgacttacggcggatatccctacatcatcaagctgatggtgcccaaaaagtaccgcggcattgacatgtatgttgaggttcccgaggtctctcaaaagtccaaattcctgtttatcatcatcacctgtaccgtcctctgcctgctgctgcccgtagccgctcccctgctgctgtccttcttcatcggcatggccgtaaaggaggccaaaatcaacaagtacacggagctgctcgaggagggcctctcctatttcggcaccttcttcctgggcctgatcctgggggtgctgtgcgaggcctccaccattctcaatcccactgtgatcattattctggtcatcgggattcttgccctggctatctccgcggtgggcggcctgctgggcggctggctcatgtatttggtgcacaaagccaagcgcgaggactttaaccccaccatcggcatcgccggcgtttcctgcgtgcccaccaccgccaagctggcccagcacgccgcccaggatgaaaatcccttcgccgttatcctgccggtggccatgggtgccaatatctccggcgtcatcacctccgccattgccgccggtatcttcgtcaccaccataggcatggtgtaaaaacgatgcacagtgatatttgattaagggaggaacttattatggaaatcaaagcacgcatccccggcaccatcgtcgccatcaacgtcaagcccggcgacaccgtaaaggcccgcgataacctgggcactatggaggccatgaaaatggagcagcccatcccctgcccaaaggatggagttgtcaaggacgtactggtctccgtcggcgacaaggtcaagtccggcgccgtgctgctgtccatcgagtgaccgtccggcgccgcccctgaggaagagaaccccctctcaaatctatcagaaaggatgccaggagcgcctttgggcggcttccggcgttggtgattcaaatgggagagatttttgagctcatcatggtcatttgcttcggcctgtcctggccgctgtctgtctataagtccgcaaagtcccgcaccgccaaggggaaaagcctgttctttgaggtgttcatctggacaggctacgtcagtgccatcattggcaagattgtcacccagaacctgacctatgtattctatttctacatcctcaacatcgtcatggtttccatcgacatctgcctctatttccgcaatcgccgcctggacgcgctggccagccgaaaggcgtaatgtatggaggcgtgaaatatggaacgtattgctgcatccctgcgcgataagatcaagagcgtggaagaggccgcggcactgatccagtctggaagtgtgattggctgctccggcttcaccctggtaggcgagcccaaggcggtgccccacgagctggcccgtcagaaaaaggccgaccacttgaccattctgaccggagcctcagtaggggatgccctagatggtgagctgaccagagcgggtctgctgtccatgcggtatccctatcagagcaacaagtccatgcgcaacgccatcaatgcgggcgaagtgggctactccgatatgcatttaagccatatgccggagtttattaaccgaggcggtctgcatattgactttgccttggtggagtgtgccgctgtcacggaggatggcgtgatcccgtctgcggcagtgggcgcttccgactgcttcttgtaccaggcggatcagattattctggaggtcaatgaggctcttcccttggagctgtacggcatgcatgacatctaccgagtaggacatgagccgatcccgcttacggatgccacacagcgcatcggaaccgctgcaattccgtgtgacttccgcaagattgccgccatcgttgtgaccaatgatccgggcggctgccctgtgtttaaagagccggacgaggtcagtgcggctatcggggcgcacatcatctctttcctgaaggaggaggtggtagccggccggcagccggcctcgttgtcccccatccagtcgggcgtgggcagcgtggccaatgctgtactggccggtctgggaagcagcggctttaccggcctgcgcatgtataccgaagtcgtacaggactctgcgctggagctgatctgggagggaaagatggcaggggcctccactacggcggtttctctctcccagaaaaagctggaactgttttatgaaaacattgatttcttccgggagcggctggtaatccgcccccaggagattgccaacaatccggagctggtccggcgcctggggctgatctccatgaatacccccattgaatgtgatctgtacggcaacgtcaactccactcacatcatgggaaataagatgatgaacggcattggcggcagcggagactttgcacgcaatgcgggactgaccatctttgccacagcctcggtggcgaaagaaggggcgatcagttgtatcgtccccatgtgttcccacatcgaccacacggaacacgatgtgcaggtaattgtcacggagcagggactggcggatctgcgctggaaatcgccgcggcaaagggcggaactgatcgtggaacgctgtgcgcaccctcaatatcgtccgcttctgcgcgaatacttaaaggacgccgcaaaatatgggggccatactccccataatctccagcaggcgctctcctggcacacgagatatctggataccggaactatgctgcccgggtaggatacgtgccaaagtttgcagcctgtcaggcagccccattcggagctgcccggcaggctgcaactgatatctcgagaactgccgggtgtgcggaatgcagatgcaggaaggcggtgaggaaatgatgacgaaaaatgcggttcagcaaatcgaggaggctgaacacaaggcgaaagaataccaagctctggctgtggagcaggcaaagaaactgctctctgatgcggagcggcaggggcaggccgcactggagcaggcgctccgtgaggcggaggcacagaggcgggaacaggatacacaagcggaacaagctgcgcagcttcgtgcagacgcgattatgacagaggcgcggcgtgcctgtgacggcctgcggaggcaggcggaagaacggcttgcagacgcggccgcacttattgtcagaagggttgtgggagactcatgtctattgtcaaaatgaaacggctgcgtatcttcggcatggcatccgactgtgaggaactccttcggaaactccagcatcttggctgcgtcgaacttcgtgcgccaacacagccaagttcagatccaggctggcagggctttaccgcaaagagcgacggggagctggcaaatgcacagctcaggatggacgagtttcgcgccacgctggagcggctgaagcgctgttcccctacaaataaaaaaggtcgcttcccctcccggccccgaattacggagcgggaactgtttgaccgacagatagttctggaggcggaggaaacggtcgaacgcgttgccgcgcttgaaaaaaagcgcgacagtatctgtgctgaacagaacaagcttatcgggcagagagaggccctgacgccctggctggggctggacgttcccctggataccgcttctacgaaacatgtattagtgctgttcgggacgctctccggcctggcaagtcatcaggcggtggaggccgccctggccgagacgaccgagctctgccaggtgcaatgggcgggccgggccggagagctgcaatatgtactggtactctgtcaccgaaaagcaggggaagccgcgcgggatgccttaaaaagctttggctttaccgccacaagctttcgaggttggaaggggaccgcccggtcaaacatcgatcagattgaggatcggcagaggatactttcacaggaactagaggcatgccgggctcggctggcacaggaggccggccaccagaccgcgcttcagatctgcatagaccgcatgacgcaggatatccaacgtatggaggcgaaagagaaactgctctcctctacatccacgttttttctggagggttgggttccggcggaacagctttccgacgtagagcatctgctctcgcagtactccgccgcctgggaggccactgatccggagccggacgaataccctcaggtgcctgtcaagctcaaaaacaaccggctcacccgccctctcaatatggtcaccgacatgtatgtctatcccgcctatgacggggtggatcccaacccgcttatggctccctttttcatcttcttttttggaatgatgatggccgatatggcttacgggcttctcatgctcgccggtggcatttttatgcgcaggaagctgcggccgagcggaacgatggagcatatggccgggcttttgatcctgtgcgggatcagtacgtttgtgatgggagcgcttaccggaagcttcttgggtgactttctcccccgtctggcgaagctgatccgcccggacacaacctttaccgctctgcccgcgctctttactccccttacggatacgctggctatcctgattggttctctggccttggggctgctgcaggtactgaccggtatggccatcagtgttgtgcggaaggtacaagcgggcacctggactgatgcgctgtgggacgaaggaacttggtggattattttggcaggggtggccctggcggtggtgggcatcggaaatttgggcggatatcccattgtccttttgattgggcttctcatgctgctctacgggggaacccggaatgcaaaaggcttcgggaagctcactgctttaattgggacggtatacaatggagccaccggctttttcagtgatatcctgtcctacgcgcgccttatggcgctaatgctggctggcagcgtcatcgcgcaggtctttaataccctgggtgaggtaagcggctcggtggcaggcttcgttatcatctccctggtaggaaacgcgctgaacttcatgttgaatctgctgggctgctatgtccacgatctgcggctccaatgtctggagttctttggacggttctacaaagaaggcggcaagcccttccggccgctgctcatcaacactaaatatgtagatatcaaggaggaagattgatatggctgactttattgcgcagtttggcggtattggcctggcgtttctgggtgccgctcttgcggtaggactttgctgtgtaggctctgccagaggtactggaatggtcggcgaggcggctaccggcgttttaagcgaaacccctgagcacttttccaaatgcctgattcttcaagttctgcccggtactcagggcctgtatggtttggttatatggttctttgcgctgtttaccatgggcgctttttccggcggcattaccgacctctccgtgacggacggactgaccatctttgtttcctgtgtccccatggccctcggcggctggctctccgcgctctatcagggccgtgtggccgcagccgccatcaatgtggttgccaaaaagccggacgactgggcgaagggaattattctatgcggtatcgtggagttttacgccatcctgtccctgctggcctctgtattgctgctgatgaacgccctgtaaggagcagcacgagggagaaaggtgggagcaaatgaacggaatccaagcgattacagcgcagattatcgctgatgcacagactgaggcagatcggattttggcccaagccagggccagagcgaaggaatgtctctccgcttatcaagaacaggcgtatattcagagcaccgccctgttggagcgcagcgagagggagtccgcccttcgggaagaacgcctctcccatgctgcaatcttagcggcgcgcaatttacggctcagtaccgagcaggaaatgagggagcgtgcctttgccgcggcattaaagcaactgtcggaattgccggacggggaatacgtagggctgctggcggggctggcggcgaaggcgtcgtccacgggacgggaggaggtcattctgtcccagaaggaccgggcgcgctatggcaagcaggtggtcacccaggccaacgagaggctgggagacggccatttgaccctgtctgtccagacccggcccatccggggcgggctgattctcagcgacggggacgtggaagtgaactgcacctttgaaacactggtgcgcctcctgcggggcgagatggaccggacggttgtggaggtgctctttggctgagcgctccgatagggaggcgaaaacttgagtaagatcagagacacggattatttgaccatctcggcccgcgtgcgggcgatggagaaccgcctggtgacccgggagcggatggagcggatggtggaggcccgcagcgacgacgaggcggtgaaggtgctgaccgagtgcggctatgaggagctgccggccctgaccaaccgtgggctggacgagctgctctcggcggcgcgggcggccctgtaccgggagctgggcggcgcagtacccgacaaacggctggtggagctgtttcagatgaagtacgactaccacaacgccaaggccctggtaaagggggccgcggtgggggcggacgccgaccggctgctgatggagggcgggcggtggagcgccgcccaggtgaaggaggcctttcagcgggacagcctgcgggagttcaccgaccccttccgccgggcggttgtgcaggcccgggagaccctcaatggtggaaatgaccctcaactggccgactttgtgctggaccgggcctattttgcggagatggcggagacggcccgcgcggtgggcagccccttcctggaggggtatgtgcggctgctcatcgacgccgccaacctgcgctccgccgtccggtgtgcccgtatggggaaggggagcgactttttgagccaggtactcctgcccgggggaaatgtggaggtccacgtgctcacgtcaggcaagggcaatgatctggcggcggtgttccgggccggtcccctcggtgatgcggcggcggccggcgcggccctcaccgctcccggcagcggggagctcaccgcctttgagcggctgtgcgacgacgcggtgatgggctacctggcccaggcccgccgcatccccttcggggagcaggcggtggtaggctatctgtacgcccgggaggcggagttcaccgccatccgcaccatcctctccggccgtatggccgggctggacgcggacactattcgggaaaggctgcgtgaggcctatgtctaactataaaatcgcggtgctgggcgacaaggacagcgtgctgggcttcaaggccctggggctggacgtgttcccggcggagagcgcggaggaggcaaagcgcacccttcacgctctggcgaaggagaactacgcggtggtgtacctgaccgaggggtacgcggcccacatggaggcggagttggagcggtacaaggacgcgctgacccccgcgatcatcctgatccccggcaaggacggctccctgggcatcggtatggccaacgtcaagcgggccgtggagcgtgccgtgggcgcggatattttgtagctccccctacgcccataacgcgttgggtgccctgtaggggcgggtgcccacacccgcccgcgccgaagacggagcaggccgagggagcggatcatcggcaatggccggaaggacgggcgaccatgaaggtcgcccctacgtccggaacgccctgcggtaggggcggcctttatggccgtccggacccccggcggagcccaacgaagtgggtctggcggggaggaggaggcgcaacggaacgagtgagcgttcccgtttacggggacgcgaaggatgtgcagtttgcgccgacgagaaagaaggttgaagcattgagcggaaaaattgtcaaggtctccggcccgctggtggtggcgacggggctgaaggacgccaacatggccgacgtggtgcgggtgggcgagcagcgcctgatcggcgagattctgaacatgaacggcgatgcggcgtccatccaggtgtacgaggagacctccggcctgggccccggcgcggtggtggagaccaccggcgcgcccatgagcgtggagttgggccccggtatcattgagaacatctacgacggcatccagcgccccctggagggcatcatgcggaaggcggggaacaacaacctgccccggggcgtggaggtgcccgccctggatcgggagaagaagtgggacttcaccgccgtggccaggcccggcgacaaggtcaccggaggcgacgtgctgggtaccgtccaggagaccagcgtggtgctccacaagatcatggtgccccccaccctgtccggcaccatcgagtccatccagtccggttccttcacggtgctggacacggtggcggtgctggtggacgggaagggggagaagcacgcgctgaccatggtgcagaagtggcccgtccgcgtagggcggccctacaagcacaagtatccccccagaaccccgctgctctccggccagcgcatcgtggacgccatgttccctgtggccaagggcggcaccgccgccatccccgggcccttcggctcgggcaagacggtgatgcagcaccagctggccaagtggtcggacgtggacatcgtggtctacatcggctgcggcgaacggggcaacgagatgaccgacgtgctgcgggagttccccgagctggtggacccccgcaccggcgagtccctgatgaagcggacggttctgatcgccaacacctccgacatgccggtggccgcccgtgaggcctccatctataccggcatcaccatcgccgagtacttccgtgacatggggtacgacgtggccgtcatcgccgactccacttcccgctgggccgaggccctgcgcgagatgtccggccgcctggaggagatgcccggcgaggagggctatccggcctacctgtcctcccgcctggcccagttctatgagcgggcgggcatggtggagtgcatcggctccgacgggcaccgccggggctccctgaccgcggtgggtgcggtgtcgccccccggcggcgacctgtccgagccggtcagccaggccaccatgcgcatcgtcaaggtgttctgggccctggacgcctccctggcctacaagcgccacttcccggccatcaactggctcaactcctactccctgtacctggactccctcaagccctggtatgacgagcacctggggccccagttcatggtgaaccgcgacaaggccatgtccatccttcaggaggaggccagcctcaacgagattgtgcagctagtgggcaaggactccctgtccgccgccgaccagctcaccctggagaccgccaagatgctgcgggaggatttcctccagcagaacggctttatggaggtggactggtactccagctacgagcgccaggacaagatgatccagatgattctggattacgacaagctgtgccgcgccgccattgagaagggtgccgccaccgccgagctgttcgccatccccttccgggagcagatgggccgggccaagagcgtgccggacgaccggtacgccgccgtctacgccgacatggcccgggagatggaggagcagatcgcggacatcgccgcccggggaggtgctgaggaatgatcaaggaataccgtaccatacaggaggtcaacggccccctgatggtggtgcgccgggtgtccggcgtcacctacgacgagctgggggagattgagctgcccgacggcaccgtgcgccgctgccaggtgctggaggtcaacggcgacaacgccgtggttcagctctttgagtcctccgcgggcatcaacctggccgagtccaaggtgcgcttcctgggccaccccctccagctgggcgtgtccggcgacatgctgggccgggtgttcaacggcatgggcaagcccatcgacggcggcccggagatcctggccgaggagtaccgggacatcaacggcctgcccatgaaccccgccgcccgggactaccccaacgagttcatccagacgggcatctccaccatcgacggcctgaataccctggtgcgcggccagaagctgcccatcttctccggctccggcctgccccacgcggccctggccgcccagatcgcccggcaggcccgtgtgctgggggacgacgcgggcaacttcgccgtggtctttgccgccatcggcatcaccttcgaggagtccgacttcttcgtacaggagttccgccgcaccggcgccatcgaccggacggtgctcttcaccaacctggccaacgatccggcggtggagcgcatcgccaccccccgcatggccctcaccgccgccgagtacctggccttcgagaagggcatgcacgtgctggtcatcatgaccgacatcaccaactacgccgaggccctgcgcgaggtgtccgccgccaagaaggaggtgcccggacgccggggctaccccggctacctctacaccaacctggccaccctctatgagcgggcggggcggcagctgggcaagagcggctccatcaccctcatccccatccttaccatgcccgaggacgacaagacccaccccatccccgatctgaccggctatatcaccgagggacagatcatcctctcccgggagctctaccgcaagggcattatcccgccggtggacgtgctgccctccctgtcccgcctgaaggacaagggcgtgggccccggcaagacgcgggaggaccacgcgggcaccatgaaccagctctttgccgcctattccaccggcaaggagaacaaggagctcatgagcatcctgggcgaggccgccctgtcccccaccgacctccagtacgccaagttcgctgacgagttcgaaaagcgctacgtggcccagggcagcgacgagaaccgctccatcgaggagactctggatctgggctgggagctgctgagcatcctgcccaaggcggagctcaagcgcatcaagccggagttcattgagaaatacctcccgaaaaaggaggggtaatccatgcccgcgattaacgtgaaccccatacggccggccgcatgggggccccgggatttcccatcctcgggcggaatgaatccgccctgcggaaatcgcctgcggcgattttgcggcgcaaaggcgccgtccccgcgcggcggggcccctctgaagtctgatggtggcgcaaggagaggaggggtaagccatgcctgcgattaacgtaaaccccacccggcaggagctgacgcggctgaaaacccggctgagaacctccatccggggccacaagctgctcaaggacaagcgcgacgagctcatgaagcagttcatggacgtggtgcgggagaaccgggccctgcggaagagggtggaggaggggctgatgcgcgcccacggctccttcaccgtggcctccgccctcatgtccaccgagatgctggagcaggccctgctctaccccaagcagagcgtggagctggacatgaccttccagaacatcatgagcgtcaatgtgccggtgtaccacttcaagaccaagagcgacgacgccggggaaatctacccctacggcttcgccaccacctccggcgaactggacggcgccgtggaggccctgtccggcgtgctccaggatatgctccgcctggcggagatcgaaaagacctcccagctcctggccgaggagatcgagaagacccgccgccgggtcaacgccctggagtatgtaaagatcccccaaatggaggaggccatccagtatattaccatgaagctggacgagaacgagcgcgccaacaccatccgcctcatgaaggtcaaggacatgttactgaaagaggccatcgaggagcgcagagaggaagatgctagagccacaaggacttttgggtcttccggtaaagcgccccgggaggtataaaggacggttttacccaaatttaccgctactacgatggaacaaaaaggaacaggcggtatcccatgggactacatgggataccgcctgtttttatttattattgtctcttatttgatgttttacccgctggttttgtctcgtacaagcatctttattgaataggccgcgattatgcggcgggcggcttttttaggggtatttatgattcccattgggcggtgaaggccccaccgcccccggcggcggccacggccatccaggtgctcccctccggcacctccaccgtgttctccccctcctccagctccaccacagtgtcgtcgggcagtaccagcaccacccggtagtcgccgcactcctgctcggcataggtcacgtgcaccgtccgcgcttcgtttcccggcagggtccagaggtactccaccccgcggaagctctcccagctcgcctcgcaggagaaggtatcgctgtagctctgccagagaaccgccgaatatcccatctcgtttgccacgatatccgcatcggtgatatcctccagggcatgcacccccatgtgccccaccccgcaggccgtcagcagcagaaacagcacggccagacagggaagcagccgctttttcatggattctgccccctctcatattctgtccaaagaatagcagccccagctttaaccgttctgaaagagagattaaaatcttatgaaagccccgtctgttcggtgagctggccggtaatgtactgttccccgtagagcatgtcataaacgatgttgcgccacgccgccaccaggggttcgcaattctctggaggcgtgtgggagggggtgccgtcggcggctacgaaaagccgctcccggtagagggtcatctcctccatagcggcggacacccactggaaatacaggggcttgggcagccccgcccaccccagcagatacgtccccaggccggtacagctcacctccgccggcgcctccagttccgccccaaagttgttccacaccaggaagtcggtgctgtgcatccgcttgagctcctccgcgtcccagcttccggtatccgccgaggacgcatagccgaggcgggtatagagcgtatcgtccccgcccagtgacagtcccggcagatgatcccccagaaagaccaggatagtgggctcctctgcctgggcgaagtagtctgtcagcttgcccagggcggcgtccgcgtcggtcaggccgtgaaccagagcgtccagcacccccgcctcctccccgctcaggttgtccgccgacgccgccaccggcgccggggtgttaaacttgccgccgaagtagggctggtgattttccatggtcaggccgtagagaaacaccgggccgtcccccttggcctcgaagcgggcaatcagctcgtcggccagggtgtcgtcggagacatagcccccggcataagtcttgtccacaaggaagtcgtcctgataaatgatctggtcaaagcccagggcggggatattgcgtgcccggtcatagagctcgtcgttgtaggagtggacaaagagggtctcataccccgccgccccgaatacccgggccagcgaaggcacacggcggtaggccgacgtatcgcccaggccggtgagggactcccccgcccccaggaaggcggaagggatgccggtgaacagttccatctccacgttgccggtacccccggcgtaggtgttggacaggaagacgccgctggggaacgcctccgccagggtgtggaagttgggcaccgggtcggcggaaaaggacacgcccggcaggcgggtggggtcaaagaagctctccgacaccaccagcaccacattgggcttgaccgccagctccgccgactgctctgcctccgcccggagctggagcaggatgcggttcatgccgtcctcgctgtagctgtccggctcggccatggcgctctcccgggcggcgctgtaaagcccggccagaaggcccagccggtcgttgcgcatggactggctctccccctcctccccggccagcagcacggcggaggccggactcagcagcacccaggccagcagggcggccagaagtcccagcacgcccagccgccgccggccgtccaggggccgggccgggcgggaccagacaaaggccgccaggaacagaagcgccgccagggctatgcccccccaggtgccctcccccagctccatgccggggcggaggaaacccgccacctgccccgcctgccccgccatggccaggtcgctgaccagcagggggacaccgttgaccgcctgcttcagatggctggcgacggacagcagcaggcagggcaggagggtgaggagctggccgcagagcaggctgtcggtcagggtggtcaccaggagctgggccagcagcagcaccagataggtgtaccccgccgcaccggcgtggctccccatccacgcccacgccgccgccggctcctggagggtgaccagttggcacaggtagaccccggccaggggaagcagcagggccagcaaggcccgcccctggggatcggtgcgccggtaccaccggctctgatgcggctgcagcggttccattctgccccactccctcctttcgcgttctttctactatagcagaaacgcggccccgccgcaagggcggggccgcgttttgaaacagagagcgctatccgccgaattccacccgcacatcccccatatcactggtcaccttcaaggaatgagggccgccggggctggtcatgaccgggcgctgttccgagccgttcagggtcagctctcccatggacaggtgcatgtccaggccgtagtcgtcgatgggttctccggtatacagctccagatcccccatggacagggtgcactccgtattcccccggaaattcccatccagatagacgtcgcccatagcattctccacggtgcaagagctgcgggtggtcaggccctccgccgtcagatcgcccatggaaaccgcgagcgcggcatccgccgcctccacgccatagagcgccagggaccccatttcactccccgcagccagggtcccggcggtcacccccgtgagcgtcacatctcccagagcggtgcggatgtccgccgactccagggcaaccccctcgggcagcgtgatcaccgccgcgacctcgtgctcccagtcagacagctcccaggcacccgacccgctgcgtaccttgagggtatccccgtccagctcatactccaactgaattccgccccaactggtcagggaaattccgtaatccccgccgtactccacggtcacgtccccaatgctcacatccacgtccagccgggagaaggccggcagcgccgtcccctcctccacatggggagcgccggtatccaccggcgtttcgcttttatgtgccctgccccagtcgaggtccaggtgggtctgtgcccccatggcaaagcccgtgatggccagcaacccccccgacatgaccaggaaggcaccagcccccaggcatacctttgccggcatgttcatgcccgcacctcccttcgattcagccagcggcccagcagcgccgccatgccgcggaagcacagcccggccagcaggaagctgcccgcgatgaggagcagccccacgccgctggacagcaggccgacgccgcagaagaacatcatggtgggcaggcccgcgctgaacagcactgaaaagcccgcgcaggcggtaaagacccccgccccgatggccaccaccccgcccacggccactccggccaccagggcgaggatcaggacgacaaggcccaataccatcgccaccaccacgaggatcagcgggatggcgatgggggcggcgcagatggccagcaacaccttccacagtgtacccaggccgtgccgctcccgggcggcgccctctggcgggcaatcccgctccgccggaaccgtccggctccgctgtgctcccaggacgcggcccaccagctcggccggggtgcccagttcccggatcacccgtccctccccctgggggcccgcctcgtcaaagtattccgtgtagtaggccagaatgcgctccagctcgtcgggcggcgtccgccccgtgagcagggcccgcaactgggccagatactcctctcgtgtcatatgctccgtcctctcgttcgagtctggagagatcataacacgtttttcttaatccgcaaccgtaaaaaacattaaaattccatgaaagggctattcgtctgtaaagtccaggcacacgtcccccgtgccgctggagagagtcagtaccctgtcccccgcgccgccggacgcgaagaaggggcccgctttctccccgtccacctgaagttcgccggtgcccgtggtcaactggtaggcgtagtccgccccgcttcccgccgctctcagggccacgtcgcccacgccggagatcagctcggcctcccccaccggagccgtcacatccagcccgcccacgccgctctcggcccgcagcaggccctccacggcgcagccgctccagtccagcgcgcccacacctatggagatctccgcccgattgagcaccgttccctccgggacggtgagcaccacctcgcccttcgggctgccgtcacccgatatattctccggtgtgctccagatctccagcgtgtcaccgctctggctgtggttcagccggtaaggtgtgccgtctccgtcttggccaccgctggtcagactcagataccagccgtccccctcctccatgcggatatcaccaatgcccacatcgatgtctaaggcggtaaagggctccagctccaacttgttttccggcggtgtggaaaccgggtcctgctccaccaccgcaggctcctgtcctgccgcaaccggctgccgttcccctgccgccggtgcgtcgggcatccgttgggccaggaataccagcctgatgcccacgcccaggagcagaagcgcggcggcgcagatgccgagtacgacgggccaaagccgcctcggccgcctttcggcggacgctgcggagggcgcctgccccgtccgcccctccagcacctgggccgccacggaggcgggggaccccagcccctcggccgcctccgcctcatgctcctcacccgcgtcggcgaaatactcctcataataggacagcacgtcctccagctccccggacgggagctttcccgccagcgcgtcccgcaggcccgccaggaattccgccttattcatgccgctcctccttttcgtccagcaaaagttcctcaatctgcccccgatagcgcgcccactccttccggtaccccgccagcagggcccgccccgccggggtgatggcgtagtacctccggttgcgcccctggaagggcttgtcatacaccgtcaggcatccgctctgctgcaagcgccgcagcaccggatagagggtggactcggacagttccaccacctccttcatccgctgggtcaggctgtagccgtaggcgtcctccttctccagcaccgccagcacgcaggcatccaacaggggagcacccaatggaaaggtcatgacgccgcctcctttcatttcaccaatattatattctgtataatattatttgtcaacagcatttcagaatccgacggagattccttccgactacggaacatcctgtatttcgccgctttggggttgtaaaaaatcaaattttgatatattatgtacggtacgaattctgataaaggatataaggtgaatcgaatgagccttcgtattggcattgatattggctccaccactgtcaaggtggtgctgctggacgaacaaaacaaactgctgttccgctcctatgagcggcactactccaaggcccgggagcgggccgccgagactctgcgctctctggcggaccggctcgccggccggcaggtgcgcatcgtcatcaccggctcggccggcctgggcgtggccaaggcggcggagatcgacttcgtgcaggaggtgtacgccaccgccgccgccgtcaaccagtacatacccgacaccgacgcggtcatcgaactgggcggcgaggacgccaaaatcatctttttcggcggcgcgctggaggagcggatgaacggctcctgcgccggcggcaccggcgccttcatcgaccagatggccaccctcatgaacgtgacggtgaacgagctggacgagctgagcctgcgccacgagaagatctaccccatcgcctcccgctgcggcgtctttgccaagagcgacatccagcccatcctcaaccagggcggccggaaggaggacgtggcggcctctatcttccaggccgtggtggatcagacggtggccggcctcacccagggccgggagctcaagggcaagatcgtcttcctgggcggccccctccacttcctcatgggcctgcggcagcggttcgtggagaccctgaagctggacgccgaccacgccgtgttccccgaggacggcgactgcttcgccgccataggcgcggccctgtgctcctccgactacggcgagcgctcctttgacgaggtgctggaccggctggagaagagcgtggacagcgtgggcctggtggacaccatgccccccctctttgacagccaggaggagtacgacgccttcctggcccgtcacaacgccatgcacccccccgaggtggacatacacacctacaccggcgccgcctggctgggcattgacgccggctccaccaccaccaaaatcgcgctgatcaccgccgatggcggactgctctacacctactaccactccaacctgggcaacccggtggccatcgtgctggagcagctccgggagatctacaagctgtgcggcagccgcatcaccatcaagggcgcggccgtcaccggctacggcgaggacctcatcaaaaatgccttctcctgcgacgccgggctggtggagacggtggcccactacagcgccgcccgccacttcaaccccgacgtggacttcatcatcgacatcggcggccaggacatgaagtgcttcaaaatccgcaacggcgcggtggactccatcatgctcaacgaggcctgctcctccggctgcggctccttcatcgagacctttgccaaggccctgggctacaccatcgccgactttgccaagctgggcctgctggccaggcacccggtcaacctgggctcccgctgcaccgtattcatgaactccagcgtcaagcaggcccagaaggacggcgccagcgtggaggacatctccgcgggattgtccatctccattgtcaagaacgcggtctacaaggtcatccgggccgccaacgccgacgatctgggccagcacatcgtggtgcagggcggcaccttccacaacgacgcggtgctccgggccttcgagcaggagctgggccgcaacgtcacccggcccaccatctcgggcatcatgggcgccttcggcgcggccctctatgccagggatctgcacctggagaagagcgcgctgctgagcgaggaggctctacagtccttctcccacaccgccaagcccaccacctgcaacctgtgcaccaaccactgctccctcaccgtcaacacctttgacggcgggcggcgcttcatctcgggcaaccgctgctcccgccccctgggcaaggcaaaggtggagaaccccgatctgatgacctacaagtacaagaagctccgcgccctccagggcaaggggaacggctccggcgtccggggccgcatgggcatccccttcgggctgaacatgtatgaaaacctgcccttctggttcgagttctttacccgcctcaacttcgaggtggtgctctcccccgagtcctcccgcaagctctacctcaagggccagcacaccatcccgtccgacaccgtgtgctaccccgcaaagctgctccacggccatgtggaggccctggtggaggagggcgtggacgccatctggtacccctgcatgtcctacaacaacgacgagggcatcggcgacaaccactacaactgcccggtggtggcctactaccctgagctgctggccgccaacgttcccctgctcaagcagaccaaattcctcaacccctatgtgggcctgtggcggcacaaggactttgaaaagcgcatcgcccagctcatggaggagcatttcagcattcccaggcgggagaccgcagcggcggccaaggcggcctacgcggcctacgacgcctatgtccacgacgtgcgggagaccggcatgaagtacatccgccacgcccgggaccaccacatgcccatcctcgtggcctgcggccggccctaccacatcgatccggagatcaaccacggcatcaacgatctgatcacctctttcggtttcgtgctggtcaccgaggacgctctgagctatctggagggctatgccccccggaaggtgctcaaccagtggaccttccagagccgtatgtataacgccgcacgctatgtatgcacccagcccgacatgcaggtggtgcagctggtctccttcggctgcggcaccgacgccatcaccaccgacgagctgcgggacattcttgaaaagggcggaaagctctacacccagctcaaaatcgacgacatcagcaatctgggggcggtcaagatccgcatccgctccctgatggccgccatggaggcccgccaggcgcaggatgcccggggctgaccatcccgactttttatagcacaacaggagtttgatgccgtcattgacggccagctcgccgccggctcgggagtcggtgggggccacccccctttgagcgcgcggcgctcccattgcaagcgaaaggaatacccgttatggcagaattagtatacgacgaaaacggacggctgctgttcaccaaggagatgaaggaggagtacaccatcctcttccccaccatgctcccggtgcacttcggcctgatggcccggattctggagaccgagggcttccacgtggagatgctcaccaccaaccaccggggcatcgtggatgaggggctcaagtacgtccacaacgacacctgttaccccgccctgctggtcatcggccagctcatcgacgcggtgaagagcggcaagtacgacatgcataaggtggcgctgctcatcacccagaccggcggcggatgccgggcctccaactacatccatctgctgcgcaaagcgctggagaaggcgggtctgagctatatccccgtcatctcggtcaacctgtcgggcctggagcccaaccccggcttcaagttggggctcaacaccctgcgcaaggcggtgttcgccatgatgtacggcgacatcatcgtacagaccgccaaccaggtccgcccctacgaggtcagccggggccagactgacgaaaccattgaggcggtggagacccagcttctggaggccatgaaccagggcaagggcctctctttccaaagcatggtggccaactttgaccgcattgtggccgctttcaaggccatccccgtggccggggagcccaaggtaagggtcggcgtggtgggcgagatctacatcaagtactcccccctgggcaacaacaatctggaggagtttctcctgtccgagggggccgagccggtggtccccggcctgaccgacttcatcatcttcaagatctacaaccgcgaggtggacgtgaacatctacggcggcaagtgggtgaagaaaaaggtgtgccaagtgctcaagggctacgtggagaagtgccagcgggccatgatcgccgccatgaagaagggcggcttccgcgctcccggcacctttgaggatctccgccgcctgatccagggctatctgggtgagggcaacaagatgggcgagggctggctgctcaccgccgagatgttggagctcatccactccggcacccccaacatcgtctgcacacagcccttcggctgcctgcccaaccacatcgttggcaagggcatgatccgcaagctcaaggacgactatcccttctccaacatcgtggccatcgactacgatcccggggccaccaagatcaaccaggagaaccgcatcaagctgatgctggccaacgcccggggcctggccaagcaggaggcggagcgccgggaggctggggaggccgctcatgtgtaaggccctctcctttgtggacgcctgcacggaagagcacttcgcggccatgagccgcagttccccacccggcttccgccgggcgggggccccgattttttatctgcgcgggcgaactgaattcgcccggcatcaaggttttgcctccggcaaaacgcttgtacgcgccacccggcgcgggcggctcatccactcgctaaacgaggtctgcttatgaattcactgcgcatcatagacgcctgcacggaagagcactttgcggccatgagccgcattcacgcccggggctggcacgccgcttaccccggccacgtgcccgacgactacctgagggacgtgatcaccgaggatcactggattccctttttccgggaggactacgccaccgggcggtgccggggcctgttgctctgcgacggggatactcccgtctgctgctgcacctacggaccggtgcggctggggcccagtccccgccagagcgaggggctggtgatccacggggatgcctaccggggctggggggagatcatctccttctacaccgaccccgcctgcaccggccggggctacggctctgtgctgatggaggaggcgctgcgccgcctccgggccaacggctacctcaactgctacgtctttgtcctgcgggagaacgagggggcccgccgcttctacgcccggcacggctttgcctgggacgggacggaggagcacattcccttccctcacgacatgacctgcgtggatctgcgctacaccaaacagctatagccgcacgggctgccacgccgtgcggcagacgggtatcgaggcgcgtcctcggtacccgtcttttttgatcaggaggaattgctttgcaggaaaacaagatggcggtcatgccggtgcgccggctgctgctgaacatggcctggcccatgatgctgtccatgctgatccaggccctctataatctggtggacagcatgttcgtggcccagctcagctccgacgggtttgtagccctggcgcttgtctacccgatccagaccctgatgatcgccgtgtgcgtaggcaccggcgtgggcttcaacgccttgctggcccgccggctgggggaggaccggcccgacgaggccaaccgggtagtggccaacggctacttcgtctatctggtctgctgggtggtctttctggtcctgggggtgggcctggctcctgtctttatggagctcttcgcccccgggcagccccaggtgatcgactacggcatccaatacctctccatcgtcaccggggcctccgtcggcatctgcatgcagtttgccggagagcgcacccttcaggcaaccggcaacactgtgggccctatggtcatccagggcatcggcgcggtaatcaacctcatcctggatcccttgctcatcttcggcatcggccccttcccccggatggaggtggctggcgctgccctggccaccgtgctgggccaggtggtgggcatggtggtggggctgtgtatggtgcggcgcagctccatcgtgcgcctctccttccggggcttccgcccggacagcgccatcatccgcaccatgtttcgtgtgggcgtccccgccatcctggtgcaggccctggccacggtgatgaacctgggcatgaatctgatcctcccactgttcaccgcctccggcgtgttcattctgggggcctatttcaagcttcagtccttcctcttcatgccggtcaacggcctgaacaacgccctcatccccattgtcagcttcaactacggcgcccggcagcgcagccgcatcactggggtcatccatttcgccctggtgctctccgccgccatcatggccgtgggcaccgtggtttttctggccatccccggccctctcctccgtctgttcgacgcagatgccgccgtgctggccgagggtatctccgccctgcgcctcattgccctctccttcgtatgcgctggggtgtcggtgatcctctgtgccgccctccaggccctgggggcggccaattccagcctggtggtttccctgctgcgccagcttgtgctccttttcccgctggccctgctgctgggcgcgctccggccctctctggtgtggctggccttcctcctgtccgagggggccgcctgtctcaccgccctgctgctctaccgccgcaccgcacggggccggctggccggtatggaggaataaatgccccctccccactgggccggaagccgctgcttccggcccggttttttcttttaagagggattttgaccccactctattgacagtatagtcccatcggttataataagcagtacaaaagccgacacaaggaggtcattcgattggcaaaagcccccaaggaaaagacgaaggtgatcgttaaaacctccacccgcatgtccaaaaagggccctttgacccccgacatgctccgcaagctggacgcctactggcgcgccgccaactacctggcggccggacagctctacctgctggacaacccgctgctgcgggagcctctgcgccccgagcacctcaagcgcaccttggtgggccactggggtacggtgccgggccaaaactttatctacacccacctgaaccgggtaatcacacgccatgagctgaacatgatctatgtctccggccccggccacggcggcaacgcggtggtggcccagacctatctggagggaacctacagcgagttttaccccaacgtgagccaggacgaggagggtatgcgccgcctgttccgccagttctccttccccggcggcatcggcagccactgcgcccccgagacccccggctccatcaacgaggggggcgagctgggctactccctggcccacgcctttggcgcggtgatggacaacccgaccctgatcgccgcctgcgtagtgggtgacggggaggcggagaccggcccgctggccactgcctggcattccaacaagttcctcaaccccgtcaccgacggggcggtgctccccatcctccacctcaacggctacaagatttcctcccccaccctgttctcccgcatcacatcagaggaggtggaggacttcttcaagggctgcggctggaccccccgctttgtggagggggacgagcccgcccagatgcaccagaagatggccgcggccctggactgggcggtgcgggagattcagcgcattcagcagggggcccgggagttcggcgagaccgcccgcccccgctggcccatgctcgtgttccgctctcccaagggctggacctgtccgaaggaggtggacggcgcgcccaccgagggcaccttccgcgctcaccagcttccggtggcggtggacgccgcccatccggagcacctggaggtattggagcgctggctgcgcagctaccggccggaggagctctttgatgccgagggcgcgccggtgcctgcccttcgggccgtggccccccagggggagcgccgcatgggcgccaacccccacgccaacggcggcatgcttctgcgggatctgcgcaccccctccttcacccgctacgcggtggaggtgcccgcccccggcgaggcggtggcggaggacatggcggagctgggcaagtatgtccgggacgtgctcaagctcaaccagaaggcccgcaacttccgcatcttcgcccccgacgaggccctgagcaacaagctcaccgccgcctttgaagccagcgaccgccgctggaacgccgagctacgctccaccgacgaggggttgtccgccgacgggcgcattatggacagcatgctctccgagcacatgtgccagggctggctggagggatacctgctcaccgggcggcacggctttctcaacagctacgaggctttcatccgcatcgtggactccatggtgagccagcacgccaaatggctcaaggtggcccggcagctcccctggcggcaggacatcgcctccatgaactacgtgctgtcctccaacgtgtggcagcaggatcacaacggcttcacccaccaggaccccggcttcctggaccatgtggccaacaagaaggcggacgtggtgcggctctacctgccccctgacgccaactgcctgctctccgtctttgaccactgtatcaaaagccggaattacgtcaatgtgatggtggcctccaagcacccccggccccagtggctcaccatggacgaggccatcaagcactgtacccacggcatcggcatctggcagtgggcctccaatgaccagggggcggagcccgacgcggtgctggcctgctgcggcgacacccccacgctggagaccctggcagcggtgaccatcctgcgccgccacctgcccgaggtgcggctgcgggtggtgaatgtggtggatctgatgaagctccagccccacaccgcccacccccacgggctcaccgacgaggattacgacgtgatctttacccgggacaagcccatcatcttcgccttccacggctacccctccctggtgcacgagctgacctaccgccggcacaacaagaacatccacgtactgggctaccgggaggagggcaccatcaccacccccttcgacatgcgggtgctcaaccgcattgaccgcttcaatctggtcatcgacacggtaaagcggctgccccaattgggcaaccggggggccttcctcattcaactcatgaaggacaagctggtggagcacaaggagtatatcaccgcccacggccaggacatgcccgaaatccgggactggaagtggaacggtggaaacggtatctgacgcgcaaggggccaggcttctgtccggccccttgcctttttccatcattttgggtatgatagatgggaaaaaaggagtgaacgtatggaatttcgactggacagccacacccataccttggccagcgggcacgcctactgcaccctgctggagatggtgcgggcggcggccgaccgggggctggagctcatctgcatcaccgaccacgcccccggcatggagctaaccacccacaaggactactttctcaacttccgggtcatcgaccgggagatctacggcgtacgggtcatgatgggcgcggagctcaacgtgatggactttgacggcacggtggatctctcccccaagctgctgaacaatctggacatggccatcgccagccagcatatctggtgcatgccccagggcggcggaccggaggagaatacagcggccatggtccgcgccatggacaactgccccaagatctgtatcctgggacacccggacgacggccgctatcccctggactatccggcgctggtgcgggccaccggggagcgcggcgtgcttctggaggtcaacaacacctccctctcccccgcctgttcccgggtaaactccaccgccaacgtgacggagatgctgaagcactgccggcgggagggcgtaccggtggtggtgggcagcgatgcccactttgtctccgccgtgggcggccatcaatatgcccaggccctgctggacgagctggactttcccgaggagctggtgctcaaccgggagcccgccgccttcctggcccacctggagcgccggctgagccgcacataaaaaagaggattccgcccggcggaatcctcttttcgtcttattggaacaggggcaggctgccagcgggacggttgatccgctttgggggcccacccagggtcgacgccataacagcgcccctgttccccgcgggcagaagccactcgtccggtaccagggcgcacttgaactcactcagctccgcccttacgcccctcctttcgcggctcccactccgacagcgccagtccggccaccgtcagcgccgcgccccccagcgagaggggcgtcaccggctcacccagcaccagcgcggaggtgaccagagtcaccaccggcaccaggtagatgtaggcgctggttctgaccgcccccagccgccccacggcaaagccccaggtgacaaagcacagggcggaggcccccagccccagatagagcaggttgagcaggtaaaccggctccgtcagagtcccgagcccgggccggaagcccagcaccggcaggacgggcagcaggaacagcaggccccaggcaaaggtacggcgggtggtctgcaccaccgggtagccgaaggcggagagcttgcgggtcagcagggagtaggctgaccaggcggcggccgccagcagggccaggagatcgcctctggggttcagctccagcacggcggcgccgttatacgacaccatcgccaccccagccagggccacggccagccccgcgaaaaagagggggcgcagccgctcccgccgcaggaggaagtgggagagcagggcggtcagcatcggactgacggacaccagcacccccacattggaggccagcgtgcaggtcagggcgatgttctccagcaggaaatagagggtgacgccgcacaggcccgccgccgcgaaccacagctcctgccgccgcccggccagccggagccgccgggggtacagcaggcagagggccgcaaagcccagggcgaagcggaggaacagcacctccacgggccgcaggccggtcaggagcaccttcgtggagataaagaagatggtcagcagggccgcggcgtgccccgtcaggcccgcccggctcacggctccccccgctctgccgcaaacacggcccggtactggctgggggtgagtccggtcaggatcttgaaaaagtggttgaagtggctctgatcggcaaagcccgcccgcagggccgcgtccaacggggtggccccctgctccagcagggccctggcccggttcacccgcaccgtttccagatagcggtagggggtgatccccttctggcgggtgaagcagcgcagaaggtggtacttgctcagccccgccagggtggagagctgctccagcgtgatgcgccggtcgcagtgggcctccagatagtcacacaccgcccgcacctcgggccgcacctcctccggcggccggggacagccgccgcagcgctccagcaggcggcccaccagcaggagaaaggcctcctcccggcggagctccccctgctcccccgctaccagctcccacacctcccggaacagactggtcagttcgctcccgggcagcaccgaaggcgtgaaatggggggcaaactggcggccggtgacggcttcagcggcccgctccatgacctcctgcggcacgtggagcccccgccagtccagacgctcctcccccaccggacggcaggcgtggggctcgccgggctgaaagaataccagctcaccgggggcaaggcggagggtttcccccgcgatggtcacctcccggctcccccgatccatggttccaatgacataataggtgtgaaaatgctccggaaacccctggtcgatgccctgaaagagacatgcctccactcccagctccggatcgtagtacacgcgccgcaattcctgttccatagggtactcctctgtctgagataaaagcagtatagcacgtccctccgcctgtttcttgcatgatattgcgcatttcccgcacagggcggcctcgccgcccatatgctgatccagggggtggtgggatgcaggcgagctccgggccgtccggcgaggcgctgctggccatcgccgcactggccgccatccagctcaccgcggggaagagcgacgcccaggcagcggtgctcggcgccttcttcaccatgctgggggacgccatcgggctgctcctggcccagcgggcggcgctggaaaatccatagcgggcggcgcagatgcgccgcccgccgcttcttgtaagctcaggagccgctcaggaaggcctgcacctcgtccagccgctccatgccctcgtcatagccgtccttccacagcgcccgaatcttctccacgtccttttcggtgcggtgaaagccctccgtgctgtggggggcgaacaggagggcccgcccctccctctcaagctgaaacagccgctcccgggaggtgttgtaggcgtccgcccggcggcgcatggtatcgcagaacctggggtacttccggtaggccgcgtcgatgaggggctggagcttttccggccgtcggacgtagctccgctcccgggtcagcaccacgatcacccgctcgcaccccctctccagcgcccgctcataggggatagcgtcggccgctccgccgtccatacacggcttaccctggatatcgaaaacagggaagaggaacggcagggcgcaggtggcctgcaatagcttaaaccggtcatcccggcgctccaccggaaaatactccgcctttccagtgtccatgttagtgaccaccgcctccacctcgccgggataagcggcaaacgtgtcatagtcgaagggaatcaactcgtttggtatggtaccaaagacgaaatccaggccaaaataggcccggttgtcccgccggagcaggttgccgaagcccatataccgcttgtcgttgatgtagtttaccataatgtccaggttgcggcggctctgcttggacacatagctgacgccataggcaatcccggctgagacgccgatgacataatccggcagcagatcccgcgtcagcagggcgtcgcagacgccggtggagaaaatggtgcgcaccgcgccgccctccagaacgattccagttttcatgtcggttcacttccttgctgctcccattatacggcagcggacgccggcctgtaaaggaattcttgacaacataatatttcgtattataataaattaggtatacaaaggaggccaagtcatgctcgtcaagttcatcgtctgcgtcgtcgccggcctgggggccggcatcggaaccggcctggctggcctgtccgccgccgccgtcatctcccccatgctcatcaccttcctgggctttcctgcctatcaggcggtggccatctctctggcctccgacgtgctggcctcagcggcctcggcctatacctacggcaaaaataggaatctggatatccgcaatgggctggtcatgctggcggcggtgctggtattcaccctgatcgggagctgggccgcctccctggtgcccaacgccaccatgggcggcttctccgtgttcatgaccctgctgttgggcatcaaattcattgtgcgtcccgtgatgaccaccaaggagagctccgcccataagagccgcgggcgccgcatcgcggagtccctggcctgcggcagcgtggtgggcttcatctgcggctttatcggcgctggcggcggcatgatgatgcttctggtgctcacctcagtgctgggctatgaactcaagaccgccgtgggtaccagtgtgttcatcatgaccttcaccgctttcaccggcgcggtctcccacgtggccatcggcggcgggctggatgtatttgccctgacggtgtgtgtggtggtcacgcttctgggcgccagaattgccgccgtctttgctaaccgggcttccgccaaggcccttaaccgggtcaccggcgtggtgctcaccatcctgggcgcattgatggtggtggtcaacctcctctcctgaagcagtggcacagccccctccggtcggagggggctgctttttgcctgcggctccggacgcccatcccagctctattgaagatttccttgacatagatagacaatctatctatactatacatagataatctatttatgaggtgaggaatatggcaaatgaccgcaccgctccgggcggcatgggcatgctgctgctggccctgctggagggccgggacatgtacggctatgagatgatcgaggccctgcgggcgcgctccaacgaggtgttccgcctcaaggcgggtaccctctatcccctgctccactccctggaggcccagggctgggtaacctccagcgacggggttgccaatggccgcacccggcgctattacgccatcacccgggacggccgggccgccctggctgaacagcaggcgggctggtacgcctacgccgacgcggtgcgcggcgtgctggagggagggaatccctgtggcgcgtgagtgcgtgaacgaatatctggagacggtgggcggccagatccgctggcggcgggcccggcgggttctcctgcgggagctgtccgaccatattgccgatcaggccgccgcctctgaggcggagggccggagcccggaagaggccctggccggcgcggtggccgagatgggagagccggaggcggtgggccgggagctggaccgccttcaccgcccccagaaccgccgggggctggcggtcactgtggcggccctctttgccgcgggcgtgctgctccagctcttcgccgccgggctcatgggggacgccaaggacgtcttctacttccggcggcaggttttgggcctgctgctggccgccggggttttgaccggactctggttttccgactacaccctccttctgcggcggaaatgggtgccggcggcggcgctgctccttttctctctggcccccctgtggggtctgccatttggctggcccttcttgagctacaagctcatgctctaccccaccctgctcctccccgtcccctacgccgcccttgtggtctccctgcgggggcgcggcacacgggcggttctcctctgcggcgggctcgcgcttccactccctatctgggcctttgtcgctatcagcagtaccggctatttggttaccctggccagtatgctgctggtactcctggcggccgtggggctgggctggttccggggaaagcggcggtggaatctgctggccgccctggggcccgctctgactatcctccccctgctcttcctgcggcacctggagtacgctgcttggcgcataggcgctttcctggggcccgacctgttttacgagcgactgcgcatgggggaattgccctccctttttgtaggctcctccccggagctcctgctggcggagaccgcccagggcctgggccggtgggtgttctgggccgccgccgggctgatcgtcctctttgccgccctgctgctccggcgcatccgcgccctccacagccgcacgggcaagctcctcgccctgtcggccttccttcccctgttcctccaggcggccatctactggctctataacctgggctggtggccgctgggcgtgctctccctccccttcctgtcctacggcgtcttcttcctgttggtggacgccgccctggcgggggtgctcctatctgtattccgtatggacgccctgctgcgggacaccgcctgggcctccagcgccccggccccccggccctccgctctggacatccccctgggccggggacagctccacatcgaataccgcaaaggggcgcaacacttttaaacatacaaaggaggcctgcggtaaagccgcaggcctcctttttctattcctcgtccgcccggtaggccatgagcacatactcccagtgctccacgcccccctcaggcacgctgtgggtgcggaggtagccgtcaatcagtcccagcagctccgcccgctcctccggtttgagatggagcgcgccgaacaggaactggagatcctcctgctgttccggctcgccgcactggctggcggcgtgcagcacgccccggaaggtgccgtccaccagttgggcggccagcgcctcccgctccccctgaaagccgtccttccggcccaggcagagccggatctccacatcggccagccggtaataggtcgcctgccggccgtccggcgccgtatatactcccagctctaccacgcccagctcctccagcttgttcaggtggctctgggccgcgctgggtgagagcagcattttctccgccacggtgttggccgtcatgggccgtcccgcccgccgcagcaggtgaatgatatcctggcgtaccgggttgagcagcacgcgaaattgtttccgttcctccagatcaatggttcttgccaccgttgtccgcctcctctgttccggccatgccgcctatctggtccgttccatgtggcgcctctgcacctcgtagtcgaaatcgccgccgtactgaatttttccatcccggaccacatggggcagccaccactttccatgctcctcctccggctccacatagccgtggctggctaggaacttccgccgggcctctaccgagcggtagagcacggacagatccccgtcccagtcctggaagcactccggcccgcagtccggccgggtgaaggggcacaccttggcgcagcggccgcaggtacagccgtgggggttggccgccccgtgggccacacacctgcgctcgtcggtccgccagagcatgtagccgcggtactcctcctgttccccagtggagatggcgtgcatggggcactgctcggcacagattttgcatacggaacagtagttctgtagcccgaagtcgatggggccgtcgggcaccaggggcaggtcggtcagcacggcggccgccttgaaagccgcccccataaaggggttgaccacgatacccagccgggagaactcccccagtcccgccagggccaccagccggggcatgatggtcacgtagttgttgaaagcgtcgctgcgggccggccagcccaggcggcggatgtagtcggccagggtgttggacatgcaggccagccgctgataggcctgataggccacggtatcatccagccactcgtccccgtgggaggccgcaatggtgggcagctgggtgcgtaccagaaacaccaccgcgtatcggtaaacccgctccaccggcgtgccgtccaccttggtggcgtaatacacatcccggggcacctcgcacactcccaccatctccgccccagtgaaataggccatctttttaatgtgccgtgtcacgatacgcgtatcctccggcaggggcgctttctccggcgcgacctcgttttccgggtagtcgttaaggtacttctgaaagtggtaataggacgccccaatgggcacgcgaaccgtaaaatcctccatcctcttcttaagtacatccccgaagccccccaggcggcacttggcgaatgccatctccttctcatccacccggggtgaatcctccacgatatccacggtcaggcgctccacccgcttgagcttttccagtggatagggccccaactgttcgtcattcagcaacaccccgcgccgcgacagatccaacgtctccattgctcgacacctcttgcttctcttatgtcaggtttcctcccactcgttgaccaccagcatatccccctgctgaagaactgtcccgcccttgggcactacagtggtgccgtcggcacggcgtaccaggacgatgagtacctccgccgggatacccagctccttgatcggcctcccaatccagtccccgtgctccgccacaggcacctcccgcaggctgaccccgtcatcgtcttcatagagcggcgtgctgagcaccataagatcccctgcctggattgcggtatctccgtttggaatcacattctcgctgccccgccggagcatcaccaccagcgcgtcggcgggcagctcacactccccgatggtccgccccacccacgggtggcccgcgccgatagggaagcgggtcaggtggagctgccgctggtcctggtagtcgttgaaggtacggctgatgctctcagcactgtccaccatgtccagcttccgcgccgccagaggcagtagtgaaccctgcaccgccactgagagcagggcaatgcagaacacgatgtgaaagaggtcgtagccgatggcggccccgctggccaccgccatgatggcaaacacgatagatgccgcgccccgcagccccgcccaggacaccagcagacactgccgcaccccgcagcggaagggggccagcagcaggaagaccgcagcgggccgggccacaaaggtgagaaacaccataatggccaaagccgggagaaaaaccgccgggagctgccgtgggaaggagagcagcccaagcaggaaaaagatcaaaatctgcgccaggcccgtaagtccgtcgaaaaagtggaccagggccgccttatggggaattttggcgtttccgatcaggatgcccgccagataggcccccaggtagccgttcccccccaccacggcgggcagggcaaaggagagcagggccgcagccaccacgaaaatagtatccagcccgtcggagagagtgagcctgcggagcaccagaatggacagccccgccaccgccgccccaaggcccagtccaaagacaacctgcgcaaaaatcatccacgggattgccccgccgccgcccacccccatcagggagagggcgatcaccgtcagcatataggaggccgggtcgttgctgccgctctccacctccagcagggaggcggtgtggttcctcaggcccagcttcttggagcggaggatggaaaacaccgacgcggcgtccgtggaactgataaccgccccggtcagaaagctctccagagcagaaaaacccagtgccaagtggcagaacagcgctgtgagcagcgcggtgaccgccacgcccagggtggacagcaccaccgcccgggccgccgccggccgggccgcctcccagcgggtaccgaaaccaccgtagaacatgatgaaaatcagcgctacggagcagatacgctccgccgcctcaaagttatcaaacgggatgcggaacagcccatccgagccgaataacattcccaacgccagaaacagcagcagggcgggcacacccaggcgctgagacaggcggctggcgacgatgcagatgacaatgaccaccgcacaaagtaacagaattgattccatgaaagccccctctcacaaataaaacaggcggccccagtccgaatgaccggggccgcttcgttctgttgaattgattatagcacaaaacaggccgtgttgaaaagaaaatcctgctatttccccctgtgtccgccatatctggggtccagcgcgtcccgcagaccgtcgccaatgccctgaaggcacagcacggtcaggatgatgcacagccccggcggcacccacacccacggccgcccggtgaggacaggcaggctggcggcgtactggatcaggttgccccaggacgcctggggcgtgcggatacccacccccagaaagctcaggctggattcggagaggatggcccgccccgcccgcagggggagggcgcaccacaccggcgcgatcacgttgggcagcacattgctccgcagaatccgccctgtccgcccccccagggcgcgggccgccaggacgtactccttctcccggaccgagagggtattgccgtacaccagccgggcgatgcccgtccaacccagcaggcccagcaccagcaccagattgagggcggacggccccaccagggacaccaggcagagcaccagcacaatgctggggaagctctgaaacacgtcggccagccgcatgaggcagaactcccaggccccccggcggtagcctgccagcaggcccaggggaatccccaccagggcgctgagggcggcggagcacaggccgatgagcagggacacccgccccccgcagagcaggcgggccaggagatcccggcccacgtcgtcggtgcccaggggatgggcggcggaggggggcacccagaagcccgcccccagatcgctggcgttgggctccagccccagcagcgggggcaggagcagcaccgccagtagctcggcgcacagaatcagcaagcaggccacggcccgccggtcgctccggaaccgctcccaggggctccgggacagcatacagcgctccaccggcctaccccctcccatagcgcacccggggatcggccagcccgtaggccagatccaggagcaggttggtcaggagcaccgccagggcgatgaccaccgtcacccccatgaccaccggatagtcccggttctcaatgccccagaagaggaggctgcccatgcccggccagccgaacacctgctccaccaccaccgagccgcctatgatgtgggggatgtgccccagcacggtggtgagcaccggggtcagcgccccccggaaggcgtggcgcaccatgacggcccgctcccccaggcccttggcccgggcggtgaggatgtagtcctcccccagggactccaggcaggcggagcgggtctgcttgaccagctcccccaggccgctgacgcacaccaccccggccgggagggccaggtggcgcaggacgtcccccacgccagtgaacacgccgtactcatacatgccctgggagggcagccagcccaagagcaccgagaagaggagcacccccaccaggcacaggaaaaagccgggcacgccgaagctcaccaggctcagggcggaggccgcccgatcccagcccgagcggggccgccaggccgccagaatacccagggggagggccagcagaatggccagtagcactccggtgccggtcagcagcagggacggccccacccgctgggccagcatgccggccaccggccggccgctcaggtaggactgtcccagctccccccggagcagcccccccagccacgccagatagcgcacgggcaggggcttgtccagccccagagcctcctccagcgcggcctgctgggcaccgccggaggccccctctcccaagtcggtaacatcggcgggcgagagacttaaaagtacaaaaaccagaaaggtaatcccgaaaaacacggggatcgccgtcagcagacggcggcggaaatagcgtcccatcttcttcctcctgcacttccggccgcccgtgggcggcacgggccggatggtacggccctacggaggttttctcatttgttcggttccgtcagccccggtacacccagtcccacacgttctcgttggagaaggcggatgaggggtagtcgatgccgtccaccgtgggggactggacgtggagcgtccgcccaaaccacagggggatgaaggggcgctccccggccagcagggcctggagctcctccacccgcgcctgccgctcgtcgtgctctgccgcccccttgacggcggcgatggcctgggtgtagggcgtcagctccgccacgtggaacaggttgttgtcggcggtaaagcggctctcggtgaaccacaggggcagggcgccgggggtgtggctggcgatggccatgtcgtacttgccgtccgccatgccagcgaacagggtggccgagtccaccgtctcgatggtgacagtgatgcccgcctccgccagctcctgctgcatcagggcggccaggccggagcggttggcggtgcaggccagggtgtaggtgcgcccgtcgtatcctccctcggccagcagggccttcgccccgtctacgttcctggcccaggtcaggccgctgtcataccccgtccccggggtcagatcggaggccgccggctcccccaggccctgggcggtatggaggcacagggcctccttgtccagagccaggtcgatggcccggcgcaccgcggcgctggggatggtctcgttgttgagcatcagctcgtagaaggagttgggcaccgtgccctccagcacctccagcccggcggcccgggctacctccgcgtcctccacggacacgttgcctccaaaggcgtagtagtccagatccccggcgatcagggaggtgagcaggttggacttgtcaatgaccgtgatcaccagccggtcaaagccgggcgccccaagctggtagtccgggttggcctccagcactagctggctccccggcgtctcggagacgaatttgcaggggccggagccaacaggctcgtcccacagcgccagctccatcacgtcctccggcgctgtcccctccagcagatgggtgggcagaacgtagtactcccggttcttgtccagcaggaagtcctccggcgtggtgggggtcttgaaggtgagcttcagggtgtacttgtccaccgcctccgctcccagggcctccccaggcaccgccgcgccggtgtcgtcggtgccggagagcaccgcaaaggccgaccgccccagggtggggcaggccgggtcggtcaggagggcaatggtatccgtccagtgctccgccgtcaccggggtgccgtcgtggaaggcggccttctcatccaggtggaacagggcggccgttccgccgtcggcgctctcccaggaggacgccgcgcggggctccagggtgctgtcggcgtggacataggccaggcggtcgtaaatcttgtcgtaaataatacgggagtagttgctccccgaggggctgttgtagggcatcagagcgtcccaggcattggataggccgtagcggacggtatccgccgctttgccctccggcccgcaggccgccagggacagggccagagccgcggccaggagcagagcagtgagccttttcattccgtcccccctcattccacggtcaccgacttggccaggttgcggggcttgtcgatgtcgcagccccgctggagggccacgtagtaggcaaagagctgcatgggcaccacgtccagtgaggggagaagcagggggtgggtgtcggggacgggaatgacgtggtccaccgtcttggccatgtccgccgcccgggcgtccacggtgaggcccagcacgtcggccccccggctcttcacctccaccacgttgctcatggtcttgtcaaagagcttgacatagctggccagggccaccaccagggtgcccggctcgatgagggagatggtgccgtgcttgagctcgccggccgcgtaggcctccgagtggatgtaagagatctccttgagcttgagggagccctccatgccgatggcgtagtcgatgttgcggccgatgaagaagatagaggggtggttgaagtagagggaggcgaaatactggatgtccgcccggttgtccagaatctgctccagcttggtggggatcagcagcagctcggacacaatgcggtcgtactccgcctcgtccagggtgcccagggcctcggcgcagtacaggccgatgaggtacaccaccgcaagctgggtggagaaggccttggtggtggccacggcgatctccggcccggcccaggtatagagcacgtcgtcgctctcccgggcgatcgtggagcccaccacgttgacgatagagagcacccgggctcccaggcgcttggcctcccgcagggcggccagggtgtccaccgtctcgccggactggctgatgaccagcaccagggttttgtcggtaacgatggggtcgcagtagcggaactcggaggccagcgtcacctccaccggcttgcgcagcagccgctccagggtatacttggcggccatgcccacgtggtaggaggagccgcaggcgatcacatagagcttgtccagctcccgcaggtagtccggctccaggttcagctcatccagcaccacccgcccctcctggatgcgtggaaacacggtcttgcggaatgcctcgggctgctccatgatctccttggccatgaagtgctcgtacccgcccttttcggcggcggagatctcccagtccacgtggcagcgctccttctcaatgggccggagataggcgtcatagacccacaggtggtcggcggtgagctcggcaatctccccgtcgtccaggtagcacacctcccgggtgtacttgatgagggcggtcacgtcggaggccagatagtgggccccctccccatagcccagaatgagagggctgtccttccgggcggcgatgagccggtcggggcagtcggcgcagacaatgcccagggcgtaggccccctggatgcggttcagtgtcttcaccaccgcgtccaggatatccccgtcatagtagtgttccagcagttgggccaccacctcggtatccgtctgggagacgaaggtgaccccctccgactggagaaactcccgcagctccatgtaattctcgatgatgccgttgtgcaccaccgcaaaccggccgctctcgctgacctgggggtgggagttgacgtctgatggctccccgtgggtggcccagcgtgtgtgtcccagccccagtgtcccgtggaccgtcctgcccccctgtaccagatcttggagtacctggagacggcccttggccttgaccacctgcaggccctcccgcctgccgtaaaccgcgatgcccgcggagtcatagccccgatattccaaccgggagaggccgtccagcagaatgggggcggcctcctcccgtccgacaaatccgacaataccgcacatgggatttccctcctgtttctatactctaaagtagtagtataccacgtccccccctctcctggcaacctcaattccccttgcccaggcggctgaggggaggtgtctccaccagaatggtgtccgcgccgaagcggcgcaccgcctcccagggaaagacccggtcctcctcccggcccagcaggccaaacagccgcaggcgccccggcaccaccagcgcccggacctgcccgctctccagatccacctccacatcccccacccagccgtagcggctgccgtcggacacattgataatctccttataccgcagctccgaaacccggcactccatcgcacactcccccttcggcacactctatgtgccgcccggcccgtcctatgcccgcttacctgccggtaactttcttgcactgccggaacaatgcgtctataatagagaaaacgaccatgccgggaggagaattccatgctggagaatctggcctactgcctcaacgccaccgcccccatctttctgctgatgctgctgggtctggtgttccgcaggctaggctttttcagccaggcctttgcggacaagctcaacgatttcgtcttcaaggtggggctgccggtcatgctcttcaaggatctggtggaatccgacttcttcaccgtgtgggacggcccctttgtgctcttctgctttctggccaccctgggctccatccttctgaccgcagccctcagcttgttctgccgggagcgccccctgcggggggaattcatccaggtgggctaccgcagcagcatcgctctgcttggggccgcctttctggagaatctctacggcaccgctggggcggccagcctggtgatcatcggcgcggttcccctctacaacgtggcagcggtgacggtgctctccctcaccagtccccagcagagcggcctcaaccgggccgcgttaaagaaagccctcaagggtattgtcacgaaccccatcatcctgggtatcgccgccggtctggtgtggacgctgctggacatcccccagcctcagattctgcaaaagacggtgtccagcctctccgctaccgccacccccctgggcctcatggccctgggcacctccttcgatctgaagaaggccctgggccgctggaagcccgccttcgccgccaccgccgtgaagctggtgcttctggccgccctctttctccccatcgccgtggccatgggagtacgggacgacaagctggtggccgccctggccatgctggccagccccaccaccgtcagcagcttcgtcatggcccgcagcatggggcatgagggcaccctcaccgccagtacggtgatgctcaccacctttttcagcatccttaccctcaccctctggctctatctgctccgcacgctggggctgatctgacacaaacggcttgggagccgggctgaatgcccggctcccaagccgtttgttcggttacagtacgcccttgcagacattgaccacaaagtcctgcacgttggtgacaatggtgcgcaccgacaggctgccccggtcgcggagcttgttcaccgcaaactcagacacgtccaccgagtagaaatacaccgggcgcaccaccccgtccaccacccggtaggagggggtcatgttgccggtggccacggtatggagggtggaggccatgcagataaccgtggtggcctcccgcaccagggtgcgcatggcgtcctgcccttcatacacgtttccatagacctcgggcagagggccgtcatcccggacggagcccaccagcacgtaaggaatgtggttgcgcacgcactcgcagataatgccgtccttcgccttgcccgcctccacgaaggcggcggtggagccgcacaggcggatggcattgagggtgtcgatgtggttatagtggccgtttggcatgctcttctgggtgtagatgtcctggcccagggcggtgccgaggtagctggcctccagatcgtgggtggccagtgcgttgcccgccagcaggccgtggacatacccgccccgcaccagggcggcgaaagccgcccgggcgtcgtgatcgaaggcacaggcaggccccatcacccacaggatgcggccatgctccttctcgtggcggagcagctcatagatggagtcgtagtccatggagtacgcggtctcccgggagcggccctggcggaatgcaaaggtctccgcctcccccttctcctcggcaaagccgaagggatagacatagatgccctcggaggcgtcctccgtgcggcccaccgccaccggctcgccggccttcaggttgcgaaactccaccgcggcgatcttcccgtcccgcagggcggccacgcagtccatgcggctctcctcagccagcagccaccgcccccccaccttgaaatactccggatagatggtggtggcgtggtagccctccggagccaccccatccttgggggccggctcaaaccaggcctccggcgcgctctggaaccgggtctcctggaagtcgggctcatggtactgcggcagggtaaagctcataaaaaagaacccctttcgtcatttttctgtcccattttaccatgaaaggagcaaaactgccaacccccgcccggaaaatagttccgtacggggattggcagtttgctgcctctttttatgagattttccctgctccctgcctttccgccggggcggcgctggaaaagagcgcctttcccacctacagatttttcttaatctggttaatcgcgctctttctcccatccgcacatgcggcggatggggcccgaattttattcttccccggcggaagtaaattccgccggggcaaggttttgcttcgcaaaacgcttgcgcgccgcacctgcggcgctggaaaagagcgcctttcccacctacagatttttcttaatctggttaatcgcgctcttttccaggcgggagacctgggcctgagagatgcccacctcggcggagacctccatttgggtcttgccctcgaagaagcgcaggttgaggatgtgccgctcccggtcggagaggcggttcatggcctccttgagggcgatgtgctccagccagctctcgtcggtattctttgagtccttcacctggtccatgacacagatggtgtccccaccatcggagtacaccggctcgtagagggagaccgggtccagaatggcatccagggcaaagaccacgtcctcccgcttgagctccagcagcttggcgatctcctcgatgctgggctcacgctggtgctcgctgatgaatttctccttagcctggagcaccctataggccgtgtcccgcatggagcgggacacccggacggaggagttgtccctcaggtagcggcggatctccccgataatcatgggtacgccgtaggtggagaagcgcacgtccaggtcggtattgaagttgtcgatggcctttataagaccaatgcacccaacctggaacaggtcgtccagattctctccccggttggagaacttctggatcaccgaaaggaccaagcggaggttgcccgcgatgagctgctcccgggcctccatgtccccctccttggtgcggcgcagcagctccatggtctcctcattcttgaggaccttcagcttagatgtgttgacaccgcagatctctacctttccctgcatggccgctgcctccctttgaccgactgaatctgtgttcagtatgtccgtggcgtggcctttcatacggctgcagggcgggctatattttttattgtgggacggttttcgatggactttgccgcccctcttgcgctttggcccggttcatgatacgataattaacaaaaataatcagatcagtttggaggtgtctccatgtttacgcctattttggacagcagccagcgccgccccctctacgaacagctctaccgctatatccggggggagatcgaggcgggccgtctcgccgccggagagcgcctgccctccaagcgggcgctggcagcccacctgaaaatcagcgtggtaacggtggagggggcctacggccagcttctggcggagggctacctccgctcggagcccaagcggggcttttttgttcaggccgtacaggaggagcaccgctctcccgctccggcccgcaccctgtccgtgccggccccgcccacgccggccctcccctatgacttctccaccagcgcggtggatattgccctctttcccttcgccacctgggccaagctcatgcgggaggtgctctccgagcaggccgcccccctcctagcctccccccacccccagggcctccctgccctgcggcgggccattgcggagcacctgtatcgcttccggggcatccgggcggacgcggagcagatcgtggtgggggccgggtcggagaccctgattggccttctggtacagcttctgggccgggaggggggctatggcgtggaaaatcccggctacaccaagacccagcgcatccttacaagctgcggcgctgccgtccgccccctcccgctggacggccagggcctgcgggtggatgccctggaggaggccggggtgcgggtggttcatgtgaccccctcccaccactacccactgggcatcatcatgccggtagcccggcggcaggccctgctgcggtgggcggaggccgcccccgaccgctatattctggaggacgactacgacagcgagttccgcttctccggccgccccatccccgccctgcaaagcctggacggcggagagcgggtggtttacctcaacacctttgcaaagagtctggccccttccctgcgcatcagctacatggtgctgcccccccacctgctggagcggtggcggcgggatttctggttctactcctccaccgtcccctcctttgagcagtacgccctggcccgcttcatggagcggggccactttgaacgccacctcaaccgcacccgcacccgctacaaagcccggcgggaagcgctgctggccgccgcccgggacactggactgacgcgggttgggtccttcgccggaggcgacgcgggcctccatctgctcctttggatggacggccgctggagcgaagccgagctggtggcgcgggccgtggatgctggggtaggggtggcccccctctccgcctgtgatctcaccccgccgccccccggccgacctcccgccctgatcctgggctatacccgtatcgccgccgtggacatggccccggccctccggcggctgaaagccgcctgggcattctgagcagggcggctctgaaaaggctccccccgggaatgttatacgtttcaaccactcccgcatgtgaaatccggcacacgtttcacttgaacaggctcagttgcacccctaggggacgcggcaccggggcgtgggccggatcctgacggagaggcagccccgccaggaagcgggagggttctccgccgctgaggagcaccagctcctctctggcgcgggtcatacccacatagagcagccgccgctcctcggcctcatcggtgtccaggcccttccgctccagcggaatgcggccctccccaacgccgcacaggaataccaccggccactccaggcccttggccccgtggagggtggagagggtcaccgctccggcggcataactcagcccggcccggcgcagcagatccccctcctgcccgatggtcagattgcggagaaaggcgggcacatccccaaaaaacaccgccatattacgcagccgctccaccccgccagagggggtgtggtgggccgtccactcctccaggagggcggtgggggactttccctcctcctgctgcccctccagccaggccagcgcggcctgcacctccccgtccaacagaaaatcctcccggccggtgaccacgcagggaatgccgtcgtgggccagacactcctccagcagggccgcctgccgccgggtacggtagagcaccgcgatgtccccgaagctccgcgcgccccgggcggcccccagcgcctgggcctccagcatgccgatgccacccaccatccgggcgatctccttggccacgaagatggcctccgcccggtccccctcggcggtgagcaggcgtacctccgccccgtgggggctgtgggtctccatgcgccggggcgcgccgtcgatggcctccgtcaccggcagggccgcggcgagaatctccggggtggagcggtaattctccgtcagcctcaccgtccgctccgcccccagggcggagaagcagccggcgtccgccccgcggaagccgtagatggactggtcgggatcgccgatggcgaaaaaggtgccgccctcccgccgccaggcccggagaagccggagctggaggcggtcgatgtcctggaactcgtctaccagcaggtgggtaaagcgccggtccgaccggccgccctcccactggcgcagggtctccagcaggaggtcgtcaaagtccagctttccctccagcttctcctgatagagggcaaaggccgggtcgtccccgccgtccgctccggtcttgtgccgggagatcgcccggaggaaggccccggggctccccttccggcccagctccgccagagcggcggccgccgccgcccgctgctcataggggccggccaggggcacggcccccagcagctccaggcagatggcgtggaaggtgccgatggtcatggcgcgggccgcccgcttgcccagacgcccctccagccgcgcccgcagctcccctgccgcccggttggtgaaggtcacggcggtgagctccgagggcttggccccccgctcctccaccagccaggccacccgctccaccagggtgtgggtcttgcccgtgccgggtccggcgagcaccgccaccgtggcctcctccgccgaggcggcggtgcgctgggccccattcagtcccccggtgggggccgccccctcctccccgctccgtgcgggcttcgccaccctgccacgggccgtcttggccgccttgggagcctccgcgccaaagaggctcacctgccccttgaggtcctcccgctcggcggggctgagcagctcgatcacaccataggccccgtcgtaccccgggcggcgcaccacctgccccgcccgcaggcggcggatgccctccgccacgcagggcccggccgcggcccggatgtcctccagcggcacctcccggagaatggagaactccggccccagggccgccagcatggcctcgtacttggcgcccaccttcttgcctgcggcagagcccccctccgaggcggcgatcacctccggcaaaggcgccaggctctcaaagggcctggcgtccgggcggacatagccctccggccggtccgccaactgctccacccggtggagcacgccggtggtcagccgcttgccgcacaccggacacacccctccggcggcctccgcctccaccggggagaggcacaccccacagttccggtggccgtcaaagtggtacttgccctcctcggggaaaaactcaatggtaccgtgaaagccctccccggtctggatggcccgggccagctccgggtaggacaggcccgtgtccagcaggttggcctcccgccccagtttggacggcgagtgggcatcggagttggacaccagggtatatccgtccagggcggaacagcggcagatcatcgtgggatcagaggagagcccggtctccagggcgtggatatggccggtgagatcgccgaagcactccccgatggtgtcaaagccggagaaggccccgaacagggagaagtggggcgtccagatgtgagcggggatgaacaccgcatcagggcaggactccagggtgatctccagcagatcccggcagtccaggcccaggatgggcctcccgtcggagtggaggttgccaatggcctccaggcggcgggacagggtctccgccgcctccagatggggcaggagaatcagggagtgaaccttgcgcaccttgccgtttttcttgtagatggagctgatctccccggtgattacgaaccggggcgcgtccggcccggcccccttcagggtatagagtccctcctccgcttcggccagcttgtcccgcagctcggcccgccaggcggggtgggtgaagtcgccggtgcctaccaggccgatgcccttccttctggcccaggcatccagcggctccggctccagctccttgctggtggcccgggagtatttggagtggatatgcagatcggcgatatacatgccgcttcctccccttcgcgttttttccccattttacccccttttccccatggacgcaagcggaaggatatgctacactggagtggacaggagggattgctgtgacactgctgaagcagtttttggagctgggactggactgctcccccatcggccttgggccgggccccagccagggcggctatttttgtacgccaaagggcctgaccgtgctgggctgggaaggcgttgacggcatccactacggccgcatccgcggctatggggatatggtgtttgccgtcaaccccatgcctgccggagagcagcatgtccgccccctggcaggcagcttccgggactttctgcgcctgcttctggcctgcggctccactaccactttggagcaggcaggagactggacgcgggagcagttcgacacctatctccgcgccccggaaaacgccgtcacgccggatgcacaggcggtgctggagcgcatcgcctccgccttccgtctcacccccatggaagaccccttttcctacatcaagggcgtacaggcatcctttgacggcggcaagctgcactataccgacgaatattacgacacgctgggcctggcccgcccggacaggcgcgaacccgcttcccagggctttgagtttgaggccgttgtgtttgcattggaaaaggagtgacctctatggacaccatgaacgctctggtctggaagggggacggcgcgctctccctggagcggcggcccatccccgccctgcaaggcccccgcgacgccattgtgcgggtgacccgctccaccatctgcaccagcgacctgcacatccgcagcggcgcggtaccccgtgcccggcccggcgtggtgctgggccatgagtccgtcggggtggtggaggccgtgggaaacgggatttccaatctccgccccggcgaccgggtggccgcctgctgcgagagcttctgcggcgactgctggttctgccgccggggctatgtcaacaactgtgtccacggtggctgggagctgggctgccgcatcgacggctgtcaggccgagtatgtccgggtacccttcgccgacaccggcctcacccccatcccggacgccctcagcgatgaggacgccctctttgtgggggacatcctggccagcggctactggggcgcggagctgtgcgccttccagcccggcgacacggcggtggtgctgggcctagggccggtggggctgtgcgcggcggagtgcgccgccctgctgggcgcggcccacgtcatcggcgtggagccggacccctggcggcggcggatggcactggagcaggggctggtggcgctggccctcaaccccgtcgatcccgagctggagtccgccgtggccgccgcaacggagggccggggggccgacgcggtgatcgagtgcgccggcaggcgggacaccttccaggccgcctggcggctggcccgtcccaacggcaccgtggcgctggtcgccatgtatgaggaaaaccagacgctccccctgcccgccatgtatgggaagaatctggtcttcaagaccggcggcgtggacgccagccgcggcccggagctggtgagcctgctggcccaggggaagctgcggacggatttcctcatcacccaccgggggccgctgtcggagatcctggagggctaccgggtctttgagtcccacgagggccactgcctcaaatgggtggtcacgccgggataacgcgcgccgcgcacagcaaaggggcgggccggaacactccggcccgcccctttctgttcttagagctgctccacaatgatatccccccgggggacgtttttccattcaaagcagcccgccagctccgccggagtcaccagctccggccggtcggtctgccccgcccagaaggccagacggccggtcagctccgccggggtgaaccgctcccgcagggcacccatgtccagatcgtgttcccgcttggacagccgccgcccgtcgggggccagcagcaggggcacgtggtaaaactccggcggcgtcaggcccagcagcccatagagatagagctgccggggggtggagtccagcagatcccgcccccgcactacctgggtgatccccatgtccccgtcgtcacacaccactgccagctggtaggcgtacaccccgtcggagcggcggagaatgaagtccccgcagtcgcggagcaggttttcccggtacgtcccctgcaagccatctgtaaaggaaatctcctggtcaggcacgatcaaacgccaggcgggacagcgggtctgggccagtcgggcgcgctcctcttctgtcaagtgtctgcacttgccagagtagaccacctgtccgtcggagcggtggggggcgctggccgccaggcgctccgcccgggtgcagtagcaggggtagaccagtccgcgctcctccagcgcccggaaggcggcggcgtaccgcgccgtccgctcgctctggaggtaggggccgtgggccccgcccttctgatagccctcatcccagtccagccccagccagcggagatcgtcggccaactgctcggcgtacgccgcccggcagcggtcggggtccagatcctccatccgcagcaccatgacgcccccggcccgccgcaccgacagccacgccagcagggcggagaacacattgcccaggtgcatccggccgctggggctgggggcaaagcgcccccgtacgactccccccacgccttacaccttgcccagctcttggttgcggcggaaggcggcctccaccgcctggatggcggcggagcggaagccccgctcctccagggcggccaccccggcgatggtggagccgccgggggagcacacctcgtccttgagctgtccggggtgcttgccgctctccagcaccatggccgccgcgcccagcaccatctgggcggcgtaggtcaccgcctgcccccggggcaggcccacctttacgccgccgtcggccagggcctcgatgaaggggtagacgaaggcggggccgcagcccgccaccgccgaaaaggcgtccatctgcccctcggcgatgcgctccacccgcccggcgggggccagaaggtcctccactccggccagatactcctccgccgtgcccgcctcggcgcacagggccagcatcccctttccgatggcggcgggggtgttgggcatgacccgcaggagggcaggccgcccctgcgcccccgccagccacccccgcagggttccacaggtcaggccggcggcgatggacaccaccgcctgcccctcccccagggcgggagccagctcggagagcaccccctccatcatctggggcttgacgcacaaaacgatgtactccgcctgggcggcggccgcccggttgtcctgggctacggcgcaccccagctccgccgccagggcctccgctttggcccgggtgcggttggcgatgaccacctgctccgcccccacggcccggcacgccgcctgaatcaggggcgcgcccatgtttcccgttccgataaatgccgcttttttcatcctgctccgcctttccgcatagtccgaaatcaatgcttccttttccgcccgccggtactttttgatggccgcctcccgccggagggccgccccccggtcgggacacgcctcccggtagaccaccgccagcggcccccggccccgggtatacttggctcccctcccccggcggtgggccgccagacgccgctccacatcggcggcggtgccggtgtagagggttccgtccccgcagcggaggatatagacccaccagctcatggcctcaccactccggccgcagctcgggcaacagctccagctcccggaagaccgccgccacggcgctctcgtactcgccggtgtcccgtgccttccggatggccttggcgtgccgctggctgtccccgaacaggtggatgaggtagaaccagacctccttcatccgcagcatggcgttgcggcggctgccgaaggccccggcgtagccctcatatacctggtcgtgaaaggcccgcagctcctcccggcccgccgccgggccgccctcggccttccgggccagggcggggtcgcccgccagtccccggcccagcataatccgctccgccgccgggaactccgcctgaaaggcctccagcgccgggacggtatagagatccccattgtagcacaccgggaaggggctgtccgccagcgcccgggcaaaataggcccggcggggggtgtttttatacatgtccttctgcacccgggggtggacaatcagctccgccaggggatagcgctggaacagcgccagcagggggccgaactcctccggctcccgcagacccagccgggtcttgatggagacggcgcagggggcggcgtcaaagaccgtgtccaggaaccgctccagttcctctggcagccccagaaagccggagcccttgcccttggccaccaccgtgccggaggggcagcccagattcaggttgatctccgggtaacccatggccgccagctcccccgccgcccacaggaagtcctccgccctccgcaccagcagctggggcacggcggtcagccccccattgtgctcgggcagaatctcccgcagctcccgtttggtgaagcggtgatcctgggtgggggtgatgaaggggataaaatagcggtccacgccgccgaaccagcggcaatgggcctgccggtacagggctccggtgagtccctccataggggcgaatgcaatcttcacggctcttgtccactcctcacgcgcagggcggcaggaggcggagcggcctgccgccccgcctcccagtgctgcttatctggaaaaattgtagcctattttgccctattctgtcaagggtgcggcgttttgccccccatctcccccaagtgcaaaaatttgggttgacaacgggaggcaggcgtgttattgtttgttatgcggttagtaattgctaaccgtcattctcgggctttaaattagctataactaacctagagaggagccacacatatgacctttgaagaggcgctgatcgagcactgctcccccactctggccggggtaaagcccgccagcctgttccgcttctgcccgagggacagcgcccttttcgtgcgccggttccttgcgctccggcagcagttcgccgcccgtggactgcggctggtcatcctcaagggctgccgccgcacgggctcctacctgctctacctgtaccgggagcgggatttggcggaggtgctgggccgcagagaacaccgggattttctgcgcgctatgggctacaccccgtgggaggcgcccggcgactgcctgcggcagctggccgcccgcctctgtctggaggaggaattcccccacgagatcggcgtctttctgggctatcctctggatgatgtcaagggattcatccgccataagggcagggactacaccttctgcggctgctggaagtgctatggcgatccccaggcggcccgccggcgcttcgagcgctaccgccgctgtaccgcggtccttcgccgccggtatgcggagggaaccccgatcacccagctcatcgtggctgcttgatacaatacgtactttcattcagaacggtattcagaaaggatggtttaatcatgggtaagatcgcaatcgtttactggagcggcaccggcaacaccgaggccatggccaattttgtggcggagggcgcgggcggccaggccgacctgttcacccccggcgagttcagcgccgatttgatttccagctacagcgcgctggccttcggctgcccgtctatgggcgccgagcagttggaagaggccgaatttgagcccatgttcgaggcggtaaagccccgcctgagcggcaaaaccatcggcctgttcggctcttacggctggggagacggcgagtggatgcgcacctgggccgaggactgcgagagcgccggctgcaacctggtctccgagcccgtgatctgcaacgaggccccggacgacgccgctgccgagagctgccgtgcgctgggcggcgcgctggccgcggtataagtacatacaaaacggccggtgacgcgtgtcaccggccgttttattgtctgacgttcctacccttccatttcgggcagctttccccccaaggcgtgctccttcatcttctgaaaggtctcttcgctcaggtcgtgctccaccttgcaggcgtccgccgcagccacctccgggtcgacgcccagccggatgaaaaactgggtcagcagcttgtgccgctcataaatacgccgcgcaatctcctcccccgagggcagcagggagataaagccgtccttgtccatctcgatgtacccgctctcgcggagttttttcatggcaacactgacactcggcttggaaaagtgcagttcattggcaatgtcgatggagcggaccagcccatggcgctcatgcaggctgagaatggcctccagatagttttctgcggactcataaatgttcataagtctttcctttctgcagcagttcctttgctacagattaacacaatccatgtgtttttacaaggagtttcacaaaaagggcatcggtcagctcaactcaaacatgccacggtagagctgatagtattcgcccttctgcgccagcagggcctcgtggctgccccgctctacgatctggccgtgctccagcaccatgatcgcgtcggcgttgcgcaccgtggacaggcggtgggcaatgacaaagacggtacgcccctccatgagctggtccatccccttctcgataagggcctcggtacgggtgtcgatggaggaggtggcctcgtcgagaatcaggaccgggggatcggccacggcggcccgggcgatggccagaagctgccgctggccctgggacagattggcgccgtcggaggtcaccatggtctcatagccctggggcaatcggcggatgaaggagtccgcgttggcgatgcgggcggcccgctcgatctccttctgagtggcatccagcttgccgaagcggatgttgtcggcaatggtgcccgtaaacaggtgggtatcctgaaggacgatgcccagggagcggcggaggctgtcctttttgatgtcccgcacgtctatgccgtcgtaggtgacgccgcccccctgcacctcgtaaaagcggttgatgaggttggtgatggtggtcttgcccgcgccggtggagcccacgaaggcgatcttttggcccggctcggcgtagaggctgatccccttcaggatgggctgccccgcctcatagccgaagtccaccttctgaaagcgcacatccccccgcaggggcgccaggctgccgtccggcctgcgccacgcccagcggccggttttttcggcgcaggcggtcatggttccgccctcctccttcacgttgaccagctccacctgcccctcgtcggtctcaggcggctgctccagcacctcaaagacccgctccgctccggccagcgcggccagcaggaagttgctctgctgggtcatctggttgatgggcatggccgcctgccggacaaagaccagatagctggccaggctgcccacgtcggtcatgcccttcagcgccatgatgccgcccagcaccgccacaagggcgtaattgacgtaggagatgctgaccaccgccggaatcatggtggccgcatagctctgcgcgccggtgcccgctttccgcagggcctcgttcttctcccggaacgcccgcaggctttcctcctcgtggttgaacaccttgaccaccttctgcccggccatcatctcctcgatatagccgtccagctcccccaggcagtcctgctgcttcttgtaataggccttgctccgcctcccactgaagcggacgtagaggaacatgaggacataaaacaccgccacgacgagggtaagctgccaattgagcagaaacagcatggtgaaggtgcccaccacctggatcgtactctggatgagcatggcaaagctgttgttgagcgcctcagagatcgtgtccacgtcgttggtgaagtagctcatcacatcgccgtggcgctgggtgtcaaaaaagcggaggggcagggtttggatgtgggcgaacagatcccgccggatgtcgtagagcaccttctgggccgccttcaccatgatttgggtatagcccaacgcagagagcacccctgcgccgtagatggcggcagtgaccgccacgcccagcaccagggtgttgaggctgccggccgccagactgttgaccaccggccggatcatataggtgccaagaaggttagccagggcgctgagggccaccagcaccgccacggccaggaacagcagcttgtgccgtcccaggtaggacagcagggtgcgcagcgtgtggcccaggtccttgggttttttagcactcagttgccgggacgccatggtcctccccccctttcatctgagatgcgtagatctcctggtagatgggatcgcccgccagcaggctctcgtgggtgcccaccgcatgcacccggccgtcctccaggatgacgatctggtcggtgtgcatcacggaggtgatgcgctgggcgatgatgagcttggtcacatccctcagctctgccagagcggtgcggatcttcccctcagtggcggtgtccacggcgctggtggagtcgtcgaagatcaggattttcggccgcttgagcagggtacgggcgatgcacagccgctgcttctgcccgccggagacgttcacgcctccctggcccaggtcggtgtccaggccctttggcatccgctccagaaattcggcggcgcaggccgcccgacaggccgcccacagctcctcgtcgctcgcgtccggtttcccccacctcagattctcccgcacggtgccggagaagagaacgttcttctggagcacgatgcccaccgcgtcccgcagagcccggagatcgtactcccgcacatcccggccgcccacccggactgtcccctcggtggcgtcgtacagcctgggaatgagctgcaccagggtagtcttggccgagccagtaccgcccaggatgcccaccgtctgccctgccgggatatggagctccacgccggagagggcgtactcccgggcgccgctgtggtatttgaaggagaccccttcaaactccacgctgccgtcgggcacctcctccaccgcatcctccggcgaatccagcacaatattctcgtccagcacctcgctgatgcggcgggcgctggccagggaacgggtgagcagcaggaacacgttggaaatgagcatcatggagttcatcacctggagcacatagctgagaaagccagtgagctgccccacctggaggccgctattgagcaccatgtttccgccgagccacatgatgagcacaacggcggtatacatgaccagttggaacaccggcaggttgagcacggcgaggcggaaggtccgctggctggtctccatgagctcagagttgaccccctgaaacttctcctcctcgtactccccgcggacaaacgccttgaccgcccggatggcggtgaggccctcctgcaccacgttgttcagccggtccaccgccttctggagccgaccgtacatgggggccacccggcgcactatgacaaagaggacgccccccagaaccggcgcacacaccagaaacaccagggccagcctgggattcatccagaaggagaggcccacgcccatgaccagcatgacgggactgcgcaccagtgggcggtaaccgccattgaccgtgttctggagcacggtcacatcggtggtcatgcgggttaccagtgaggaggtctcaaatttgtccaggttggaaaaggcatatttctgcacccgctcaaactgggcctcacgaatgttggcgccccagccataggcggcccgggcggtaaagcgggcgtacagcagccccgtggccagggccagcagggcgcagacgcccatctgaattcccctctggaggatcaccgccacatcccggttggccactcccacgtcgatgatgtccgccatgaggacggggatcaccatttcaaatgcagtctctaggatgatcatcaccgccgcgatcagcagatcccgccggtacggccccagatagcccagcagccgcctcaactccctcatttcgttccctcctcccgctctgcccgaagattccggtaggcccgggacaggtaatcggcaaactgccgccgttcttccgggttgaagccgctcagcatggcctcctccatgacccggcagcgcctctgccagtccaggttgatctgcctgcccgcctcggtcagctccaccacgtctctccggcggctctgcccatccgccctccgggtcacaaagccgctcttttgcaggcagtccagcatccggcacaccgcagcggggtcaatctcaaagtagtccgccagttcccgctgacggcagggcccccggttcatcaggtagttcagcagcttgggctgcccaggccccagccccagctcgcccaggctgggcctcaggaagttgcgctgggcgtgaaacgcccggtacagcagcatatggaaggttcgctccacgttccgccgccccctttcttgatatatcaataattgatatatcaattatataaagttctccccgattgtcaaggcttcatttgttccctgcaaattttccctgggtagccgcacctccactggtacatgctatgcgggaggtgatttcatgcgtccggtctatacggatctctacgcgctcttccgccgcgatcccggcgcggaggaatatttcaatcagctccccgcctatgtgcaggaccagctcagcgcccgctgccgggccgtagactctctggagcgtctgcacgcctatgccgatcagttccaggccaagggttctccggagctggtggaggagatcggcggaaaggcctttctccctccgccgttccgcccgtgagcggtatatggcggggtgatctccccgccaaaacaagcaaaatgcctgctgctttcgcaacaggcatttcaaaaggcttatttccgcttggccagctccttccaaacggcctgggcgatcacttcctgcccctcaggggaacggagcacctccagcaccatggcgcggaactgctccctggcctgtcggcccccgaacagggcgtccagcatggtggccccctgggagggcgcctccgctttcatcttctttggggccggggcgggccggtagaccggctcctcgtctgccccggagtacccctcactcatccagtcctcctgccgggtacggtcgttgctctccccccggaggtaaaacagggacacgccgaaataggaggccagcttttcctgctgctccttcgtaggggtctggcggcccgtttcaaacttctcaaaggcgtttttgggaaatcccagctccagagaggcgggcacccgtgccaggccggcctcggtgcgcagcgcctcgatcctctgtgccattgtcaccatggttaactccttctttcctgtattggattatttacttattataccgccccggcaggcgggccgcaagccttgacatatgctccgcccggtggtatcctagcttcataccaaggaggtgtgtggatgtccgtataagcgattcgccgttttgcggcgcagcctggagaggggcggaggcctctctgtttgtgttgcccaaaccggagaactgcggtacggaccgccccatgcgcccctgtccttatgggggattttccgctcgcgggggggtgcccgcgcctttggcgcgccggttctccgcgggcgttttttgtcacctggaaaggagtatcagaacggatgaaccgtgattctgtgcgcggcgcctgagcgaaggcttcggcgccgtatcccacccgctggtagcctttgctcattccaaatgattccatcgagtttggaggagcaccatgcgctatcaaaacgcagccgagctgctgcccgccgagctgctggaggccctgcagggctatctggacggcggttatctgtatatcccccggcgggcggagcaccgccgggcgtggggagagcgcacccggcggaaggaggagaccctggcccgcaaccgggccattttccgggactacaccgccggtctgggcgtggacgagctgtccgcccgctattttctcgccccaaagagcatccagcggattctcaccctgggccgccggggcctgctggagccatagtcctgcgccggagcgaagcacgctccggcgcagctttttttcggtaccgtctttgcggttgcctccgcgcggcccgctctgctacaatgggcgcgaaagcgaggcaagatacccatgaaccaatccaaccttctcaccgtccgcgtggcgggcgtcatgaaccgacaggccgtcgtgctccacgcgggccgcaccctcccctgcctgctgtctggccggctgctccggcagaaagatagcctggccgtgggcgaccgggccgaggcggaggtcctgggcggcggccagtaccgtctgacgcgcatcctcccccggaccagcgccctgcgccgccccagccgccgcggctccggggatgcccttctggccgccaacgcggattttgtgctggccgtgtgcgcggccccctccctgcttcgcgccttcgccctcccggagtgggcgctggaggccgcccgggcggcgggcctgcccgccgggctctttgtcagccactgggaccggctggccccggaggagggagacgccctggcccgccggctggagccgctccgggcggagctggacagcctggcctggggctccgccctggagcctcccgccgggcttctccccgccctgcgcggaaaatccgtggccgtgctgggcggcccggggtgcggcaagaccgccctgatccagcgtctggccggggtgcaggcccccctccgccccaccactgccgtctctctctcccaggggccggacggcaccctctggctggacacccccggtttccggggcgcgtcccccgccgccaagcccgccccggactaccgccgccagccctgcggggagtccttctcctgcaaggcctgcggcgcgctggtcaccccagagggggccgccagccggcaccgcaaccactgcccccactgtctgtccagcctccacgtggacgaggagcccggcgaccgggcctgtacctgccgggggattatggagccggtgggcgtgtgggtgcgcaaggggggcgagtgggcgctcatccaccgctgccgcgcctgcggggccctccgctccaaccggatcgcggcggatgacaacccggccctcctcctctccatcgccctgcgccccctggcccagcccccctttcccctgtcctccctgtccggggtggatctttcccgggaaatgcggcataatgagggaaacgacagacaggaggcagacgcatgacacaggactggacactggaggaggccctcgcctattaccgccgccagggggcgccgggggagcagggggcgctggtggccctgctgcgggaggtgcaggaggagcgcggcggcgcactgcccgccgccgatctggcggagatcgccgccgccctctccctcagagatacctttctgtccgccatcatcaggcgttaccccggcctgcgcaccgaggaggccccccaccgcctggagctgtgcggcggcccccgctgctccggccggggcgcggcccgtttggccgcctttgtggaggagacctacggcgtgcgtccgggcggcgtcagcgccagcggccgcttcacctaccgcatcaccggctgtatgaaaaactgccccaacggccccagcctccggtgggacggcgcgctccactcccgcgctgacgaggctctcatccgcgccctggtggacgagggcggcgggcggccttccccttgacagtttccctccgctgtgctacgatcggttagtagttgctaacaatatattccggcacagcggagcggaaagggagcggttttatgacaaagtatactcttgtggtggacgggatgatgtgcggcatgtgtgaatcccatgtaaatgacgccgtccgcaaggccttccccgtcaagaaggtcacctcctcccacagcaggaaacagaccgtcgtggtggcggaggagcctatcgacgaggcaaggctgcgccaggttatcgacgcgaccggctacacggtgcagtcggtgagctgcgagccctatgagaaaaagggtctgttctcctggggaaaatgagcgaaacagaggggcggagcgccggccggcgctccgcccctctgtttcgcagccgcttcacacgcccggaagcccgcactccagcaggcggcacgtcccctccgccgtacactggtaggaggccacgccgtgggggacaaagagctcctcgcccctgcgggcccgcagggaaccgccctcccattggaactccgcctccccctccagcaccaggagcacctggaacccgcggttgacacagagggcgctcccatgggcctcccggcgcagctccacctcatccatatagaagcggggggtctgctccggcgtgatcagccgcttccgccagggctcttccgccccgggggcggggcggaaccggtgccgggccagcagctcctcccggggcaggcagtcaaaatggaagcagtccagcaggccgtccatgccggcggggccatacatgctctccaccggcaggcgggaaccgtccgggcggatgtactccgcccgcagggtgatgtccaccggctcctgcagctcggccaccagggaatcgctccccatggcgtgggccgtgcccgccgggatgaagtacacctcccccggacggatggggatctggtgcaggcagtccagcagggccgccgtgtcctgccgctcgatcagcccccggaaatacgccggcgtgacgccgggccggaaccccagccagatgcacgcccccggacgggtgtccagcacgtaccacgcctcatccttcccggagggcaggccgaaatacttccgcgcccgcgccccgtccggatgggtctggagcagcaggcggtccctggagtggagcagcttgagcagaaagcccaggctggccccccagcgcgcggcgtgagcctcccccagccaggccgcagggttttccgccaggcagtcccgcagtaaaacgtccgtccccgccacccgggacagccccgtggcagtgccgggctggagggcggaggtcaccagggaggcgatccacatctgggaacacacccgcgcccccggcccctcccccagaaactcgttgatcatctcgcccccggggatcaggtaatccaccttgttgggggccagcttgagcatttggttcggtgataggtccattcgtcccagcctctttcccattgtgatactggggccagtatatcacaccgcagggccctgttccagcgtttctttttccagggcctcccggagcatctcccggagctccgcctggcccggcacgcggccgcaggacaccacccggcctcccaccaccagggccggggtggtcatcaccccataggcggcgatctgcatgaagtccgtcacatgttcaatggcggcgtccaccccaagctccgccaaagccgcacggacggccgcttccagggcgctgcacctggcgcacccggagcccagcaccttgacgctggcggcggtcttgtccgctcccacccgcaccgccgtttcaggggtacggccacagcagggcgggagcgtaccttttttcttttttccgaacagtcccatgtttcgttacctcctaaatggaaatcagatagaattggaacacgttgaacagatagccgatgaggataataccgcctgtgcagatggcgataaacagccccagcagtctgggcttcaccgccttgcggagcatgatcatcgagggcaggctcagcgtggtgaccgccatcatgaaggccaggaccgtaccgagctgcgcgcccttggcgagcagggcctccgccaccgggatcgtaccgaaaatgtccgcatacatcgggacgcccaccagcacggccaggacaacgccgaagggattgctgccgcccagaacggcctcaatccatgactcgggtatccagttgtggatcaccgcgccgagccccacgcccaccaggatgtagggggctactttcttgaaggtggacacagcctgctcccttgcgtaccgcacccgctctcgccttgtcagctcgggcgactcaatgtctatactgccggccgaaaagacgaattgctcaacatgcttctccatgtgcagccgctccaggagtgtaccgcccgccacggcaagcgccagccctaccaccacatagaaaatggccaccttagtcccaaagatgctcatcagcagcaccagactgcccaagtccaccatcggcgaggagatcagaaaggaaaaggtgacgcccaggggcagccccgcgctggtaaaaccgatgaacagcgggatggacgagcaggagcagaagggcgtcaccgtccccagcagggcggacaccagattggcgcccacgccgtggagccggcccaaaatgtgcttgctccgctccggtgggaaatagctctgtatataggaaatagaaaaaatcagaacacagagcagtactgtaattttcaagctgtcatacaggaaaaactgtacactgccgccgagccgtccatggatatccaggcccagcgcggacaggccgcgtccgagccactcgttcagccacctcatgcccaaaatctgctcctgaaacaggctccataactccatatcgttccgcctccctttatgtattatagatcaagtttttttgatgttttgctggaaaacacgccatctactgtgacggcgcgttccgctcccgctattcaagcggtgtcccctgttctgtaaccggcgtagtcagctccagcagcagcttcaccgcgcactccctgcccgtcctgctcagctggtagtgggtccacttgccctcctgccggctctccaccaagccggactcgcacagcaccttcatgtggtaggatagcccggactgggtcagctccatgggctcctgcaagacacaggcgcacttttccccgccgcgcagctcctccaaaatggccaagcgcttgggatcgcacaacgccttgaatacccgagccgccgccctataatctctttccataaagccctcttcatatcaaatatttttgatattattttatatggcttttcttcaatcgtcaaccctcaatttttaagcaaaagccatcccagcaggaaagccatactgctctgcctccgaaaacaaaggctgtataaaaactctgcatgtcaaatccctttccagcagaacatcggcagagtggacagagaactcttcgtaactatatagaacaagcggcacactgtgcccgataccgtataccttgtgtcctgtcacagtacagcggcgggccggttcgcctacaactttgtagctgatatgatcacaaaaagtattttcagataagttgacaccctttccgctcaatggtataataacaccgttatataacactgttataaggcggtgaagtttgaatggaggagcggtccactgctacactggaaaaaattcagcaggcggctttggcggaatttctggacaagggatttctgggagcctccctgcggcagattgtaaagaacgccggggtgaccaccggggccttttacggctacttttccagcaaggaggccctgttcaacgccatcgtggagccccacgccgcggccctcatgggccgctttatggaagcacagactacctttgccgagctgccggaaaaggagcagccggagcacatgggcctggagtccggtagatgtgtggactggatggtggactatatctgcgcccaccgggagccggtgaagctgctgctctgctgtgcggaggggaccagctatgagcacttcgtccataacatggtggaggtagaggtggagtacacccaacgctacatggaggtgctccgccgcctgggccgggacatcccggtgctggacaaatccctgtgccatatcatcgctagcgggatgttcaatggcatctttgagatcgtggttcacgatatgccccgggatcaggcgatgcgggatgtggatcagttgcgggcgttttacaccgctggttggtcaaaactgatgggggaataatcccctatctttttgaaatatggttagtttatactaactttaagaggaggttttttcatgaagcagaagagaaagagcgatgtggccgtcttgctggactacgcgggcagccacaaagggctgaccttcctggggctggccctgtcggcggtgtccatgctgctgagcatggcgccctatatctgcatctggctggcggcccgggacttgatcgcggtggcgccggactggacggcggcgcagagcgtcgcccaatatggctggctggcgtttgcctttgtggtggccggtatcgtcctgtacttcgcgggattgatgtgcacccatctggcggccttccgcacggcggccaacatccgcaagcagggcgtggcccatgtgatgaaggccccgctgggctttttcgactccaacgcctccggcctcatccgcgggcggctggacgcggcggcggccgacacggagaccctgctggcccacaatctggcggacatcgtgggcaccatcaccctgttcatcaccatgctggtgatgatgttcgtctttgactggcggatgggggcggcctgcctgctggcggcggtgatctccattgtggccatgttctccatgatgggcggtaaaaacgcccaaatcctgggggaatatcaggcggccctggaccgcatcaccaaggcgggcaccgagtacgtccgaggtatcccggtggtcaagatcttccagcagaccgtctactccttcaaggcgttccaggaggcgattgaggactacagcaccaaggccgagcactaccaggcggatatttgccggacaccccaatccgtcaacctgaccttcaccgagggggcctttgtgttcttggttccggcggccctgttcctggcgccgggtgccctggccgggggcgactttgcggggtttgtcacgaacttcgccttttatgcggtgttctccgccatcatctccacggcccttgccaaaatcatgtttgccgcatcgggcattatgctggctggcaccgctctgggccgcattgatcaggtcatgggcgctcccgagctgaaagtgccggagcatcccaagtccccccagagcagccgtgtggaatttgaggacgtgagctttacctacgacggtacagagacgcccgccctctcccatgtgtccttcacggcggagccgggacagaccgtggccctggtggggccctccggcggcggcaagaccaccgccgccagcctgatcccccgcttctgggacgccacctccggcgcggtgaaggtgggcggcgtggatgtgcggcagatcgacccccatgtgctcatggaccagatcgcctttgtgttccagaacagccgcctgttcaaagcctctatcttggaaaatgtccgggccgcccgccccgacgccacccgggagcaggtgcgcgcggcgctgatggccgcccagtgcggggacattctggagaagctgccccagggcatggacaccctgatcggctccgaggggacctacctctccggcggcgagcagcagcgcattgccctggccagggccatcctgaaggacgcgcccatcgtcgtcctcgatgaggcgaccgctttcgcggaccccgagaacgaggcgctgatccaaaaggcattctccgaactgacccggggccgcaccgttatcatgatcgcccaccgcctgtccaccgtcgtgggcgcggacaagattctggtgttggaggagggccgcatcgtggagcagggctcccatcaggagctgaccgccgccggcgggctctatgcccggatgtgggcggactacaaccaggcggtccagtggaagatcaccagcgaaggggaggcaaaataaatgttctctaaaaagtttcagcggaaatacgccctcaccgaccagggcgtgagaaacaccaaaaagggcgctttctggacggtcattgtcaatctggtcgtcatgggcggcatgggcatcctgtacctgttgatgtacggcctgatggggaccctgacggacggagcgccgctgcccggcccggcgctttttcttgggctggtaatcgcattcgtcatcctgtccttcgtgacccacctgcagcagtaccacgccacttacggcctggtctataacgaggtgaagtccacccgtctcagcctggcggagcggctgcgcaagctgcccttgggctacttcggcaagcgggatctggcggatctcaccgagactctcatgggcgatgtgaaccgcatggagcacgtctggtcccatgtgctggggtacctgtacggggcctacatctccacggccattatcgcggtgtgcctgctggtatatgactggcggctgaccatcgcctgcctgtggggggtgccggtggccttcggcctgttgttcggcacccggaagatctccgcccgtgcctcggaacggacgaaacaggccgcggtccgtgtctccgacggcatccaggaggcgttggaaaatgtccgggaaatccgcgccaccaaccaggaggcgcgctatctggccgggctcaaccagaagatcgacgaccatgagaaggtcaccatccagggcgagctgggcaccggcatctttgtcaatgcggccagcgtcatcatgcgcctgggggtagccaccaccatcctggcgggggccagcctgatcctctccgggcagatcgacttcatgctgctgtttttgttcctgctggtcatcacccgtgtgtacgcccccttcgaccagagcctggccctcatcgcagaactgttcgtgtcccaggtgtccgccgaccgcatgaacgagatttatgatacgcccaccgcagagggggccgaggtgttcgagcccaagggccacgacattgtgttcgaccatgtgggcttcgcctacgacaagaagaaggtactggacggtgtgagctttaccgcccgggagggtgaagtgaccgctctggtggggccctccggctccggcaagagcacctgcgcccggctggccgcccggctgtgggatgttacggagggcaccatcagggtaggaggcgtggacatctccaccgtggacccggaggcgctgctgaccgactactccatggtgttccaggatgtggtgctctttgacgataccgtgatggagaacatccgcctgggcaagcgaggagccaccgatcaggaggtgagggccgcggcggaggccgccaactgcggggagttcatccgccgtctgccccagggatacgacacccccatcggagaaaacggggcgaagctctccggcggggagcggcagcgcatctccatcgctcgggcgcttttgaagaatgcccccatcgtcctgctggacgaggccaccgccagcctggatgtagagaacgagaccaaggtgcagggggcgctctcccgcctgctggcaggcaagacggtgctggtcatcgcccaccggatgcgcaccgtggccggggcggaccacatcgtggtgctggaaaatggccatgtagctgagcagggaactccggcggagctgatgggaaaaggaggactctaccgccgtatggtggaactacagagtcacagtgcccagtggcaacttaacgggaacaaatagcggtcaggtagaataagtttcgcaaaaagacaaagagacatggtttgcagatgtctggtagaatgaagttgcgacaccaccattcgaaaggagacagcaaaccatgtccgaaaagattgtacagctaaacgaagaagttatcaaggggcagctcaaggaacttgtgcgcggaagcgtagaggaaaccctcaacgagctgctggaggccgaagcggagaagctgacccaggcggcccggtacgagcgcaatgagcaacgccagggctaccgcagcggccactacaaccgcaaccttaccaccacttctggggatgtcacactcaagatgcccaagctcaaggggatctcctttgagactgccatcattgagcggtatcgccgccgggagagtagcgtggaagaggctctcattgagatgtacctggctggcgtatccgtccggcgtgtagaggatattaccgagactctctggggcagtaaggtctctccctccaccatcagtgagctgaacaagaaagcgtatgtccacatcgaggattggcgtaaccgtcctctgcaaggcgggcggtatccgtatgtctatgtggatgggatctatctgcgccgcaactggggtggagagtttgaaaatgtggccatcctggtggcaatcgcggtcaatgaggacggatatcgtgaggttttaggtgccgccgagggcatgaaagaggacaaggccagttggatcaacttcttccagtggctgcgtggccgtggcctggacggcgtgaaactcatcgttggagataagtgccttggtatgctggaggccgtgggcgaagtgttccctgaagccaaataccaacgctgcaccgtccacttttaccgtaatgtgttctctgtcacacctcgctccaaggtgaaactggtagccaaaatgctcaaggcgatccacgcccaggagagcaaaaaagccgctcgtgaaaaggccagggccgtagtggaggagctgtgttccatgaagctgaaagaggctgctaagaaggtggaggacagcatcgaggagactctgacctattgtgattttcccagtgagcattggacccgtatccgcaccaacaatgtcattgagaggctgaaccgggagatccgccgccgtactcgtgtagtgggcagcttcccggacggcaactctgcccttatgctggtctgtgcccggctacgccatgtagctggctcccagtggggcaacaaaaagtacatgaatatgaagcacctggaggccgccattgaggatgcctccattgccggctgactccattcatgccagagcttgcaaactaaagtgcgaaaaaatcttgacacgacccaaatagcataggaacccgtagcagagactaggtagttttcctttatcagaaatttggccgctgatctgttactggtttttcgtttggaattatgaaagaatcaatcataaaacataaaaaggtcttaccgatttgcaaaaatcggtaagaccttttgttattaataagctatgcgttgcacttaaagacctgtgatgatctgactgaaatccaagaggtgtgaattgggaaagtattatcagatacaaaaaattttttcttaaaagcaccgttttcccggctaaagcaccgcaagagccggagacagaatgaaatctcctcattcccactcgctcctgttagatgttttctaaacagatttgcttatgggatttagctcagagtattggcattcttttcattattcagatagtaggggctatctgattttttgttgccatggtgttgccaccaatgaatttttctgatgattattctgtcggagtccatgtttcaataattgaattaccaatatcagaaatttgagtcaacaaattatttctgacatcagcatcattctcattgtgtgcttcccgcaccaattcaactaggtgcatatgctggtggtttctttcatcaaattcaggcaaccgcatatgtttgaaaatatcgcccacttgtatcatgatgtgaaaactggcaataaatttttggacaagactgcatgtaagcaagccacataagtagagtgcagtggtttcatcgtcaaactctgcaaagtaaattttgtgatccggaacaacaattttctcgccgacaccttgcagtgttctcgtattaactaccgctacagggagtccgctattaccaggctgttcaggccaaactactttccatggcgcaaatgtatagccacccacattatataccgcataatatggagcggaaggcattcttgtccgatatgtggagcgactccgcagctgctgttcaaatgcacggaaataatcatataaaagccgattgttttgctcaacttccgtttctgcttgggatagccatgtggatgtaattccgcgatttgggacgattgcatataactcatgttgcgggttatactggcaggccttcaggtcggaagctcccttaatcaccggataaagcaaattgtgttctacccaaaaacgacgtttagggccaatgtttgtgcgacctgcttcaggccttgtttcgatttgtacacgggtgccatcgtacgacacattaactacatttacaaagtatacaccattaagatcacatgtaattcccttacgcccctccgtccatgtacatttgccaactaattttttgcatatgtcaaaatcaccggaaggcaggattgcccaaggggacgagcctccttgaactggatttgcttcaagaaaagtgcgagtagtccgatttaatacctcttgttttgtggcatgctccggaattgtgcgtgattttccttgggcactactccatacagcatagtcaacggggaaagacggctgtactccgcctttttttgcgacaaaaatcacagttttatttgccgcatcaggaaatggttttagggctttcaaatcctctacactttcagggaaaaggaaattattctcatcaatgcgaaaacgtctaaatccctccgaggatgctgactggaagtgtgtttgtgtaagcaagaagatcagttgcccaccacttctgagccatttgtcagagactgtgtaggtgataagtccagaaatgtccaactcattcccgccgtaataaggtgtacgtgagaaaatatcatatttacggcatgtaggagccactctgttccgatacagttctggtaactttgaccagcggacccacgggggattgccaactattacatcaaactcacccgcggttgatgaccagaagtaattgcggacaattcggaaccaaatcccgttccaatttcttctatgaagatctaagacacgtgcataagttgatgaaagtataggctcccaagattctctttcttctacagttatcgcattgtgcacaaggagtccatctatcatacgaacaggctccatatcattttccacacattcacccatgatagaaaacaccgtatcaagccgatctctactttgtgacaatactgttggcaaggtaattgtcaaatcagctacgttgcttcctatgacatagttcactacgctagtatctccctcatcgggagccggagcatagattgcatctgccagtaatataggaatctcaatatgtatccctggagcttcagcaatcaggtcagaaagcgcaatcagataatttacacgagctgtttgcaccgccagtgggtttaaatcaaatccccacacattttgagttattctttgtaacagatctacagcagacaaatttgagcattctcgaatcctttttataattgctaatagaaacgaagcagagccacaagtagggtcaaggaattttagctcatcaaattggccttcaactttatctaaagtcacgtctacaagccaatctggcgtatagaattctcccaagctctttctcaacacttgcggcacgatattctgatagaatcgtttaagcacatcatttgtctgagcatgggacaggtcttccatttgatacaaagaaagttttatcagaacctcttttaatgatgtaacaatatcatttacaacttcaggatatacattgcttgtacatgcatcaatataccaactaaacaacggctcttccacgaaaccgtgtatatttgcccttgtataaagttgtgagcgttcgatatccaaatctagcatcgagataagctcgtaatcacttacagacacagcattttgggcaaaatcagaatatgatgttaactcggtaagatgagaaacaatctcagcagataagagtttaataataattgaatcaaatgtgtgaatcacgaaaaggatacgagacaacttatcagttgatgtgctagtacaagtaaaaccaatagagtttataattgcttccacttgaaaagaactaagatcagctacttgcccatataaagctttccattcttggtaaagcatcttgactttgttgttattaggatcatcaagatatagcattaacgcagtagcaagagcctgcatgagattaccaccagcaactgaaccatgaccaaaatcttcaattaaattcgttgctgttactgctctacggcaagactggcggcatgcttcgaacaccatttgcacactatctggagagagtggcataatggggccaggaatgggctgtccattttcagatgaaatgtgaacaaaagcaatcgattcaccatcgatggcaattccttgataatgacgcacatctaaaccttcaataccagcctttgcagggatatatcttgagagttcctctaatgcttcctgaaatttagcactattttgattgccatgaaataggcctacattcttaaactcaataataacttgattgtagtcagcatcagatcgccctctctctgcatgaaatgtgatcgcgagcgtattctgtaaaatggtaagccaacctagtctaacttcctcttctgtttgccaatctacgcgctggcgattgagctgattgtattgttcggtatacattatttttccctcatgacacaattatttctcttacagcaggcttcaatcgaaaccgttgaacttgttttacttggtcgtttcctgcgttaattccattatatctccaatgtcacactgtaaagccgtgcagatttttaccagcacatctgtagtaacattttcattttttcctaatttcgccatcgaagcatggctgattcctgccgccgcacatagatcttttttcttcatatctctgtcaattagtaatttccaaagctttttataactaacagccatcttccacacctcagcaacaagttatatattctgaaaacgctgagcgctattcagtgttcgcaaactttttggttattatatcatatttgccttagtgcttcaataagggattgtgaaagatgaaaggctaacagttaaagtttttaaatagtgcgcgacacaattaagtgttaaagtatttatggttagtaattactttcaaatacctgtccggctcaccatttaaaattagattgacatactccaacggagcgttatagatcaaccagtccagttctgacccgctggtgcatactgtttgccacctcgttcgccacggcggtgcagtcgatggagagcagcgtcccgtcttctaggcaaagttccacgcaggcggtgtccaggtttaactcacaggacaaaatctttctcatagtcgttacctcctaatacttaaatttcggttgattttccgcagcgacacaaggttcgtttcgctaattttagaatctggcaagcaatgcgtgtggctatccacacacaaatccagcaagcaatgcgagtgttaatacacactcacatttcctgccgtctgcttgttgagggcagtgccccccaagccccctttgaacacaggatttcattctgtggctacgcgttctgcgaacgctttgaaagggtacgccaaagcgccgtcccctttaagataccatggaacaaatcgttccacccttacgcctgatggctactgcgaaacacagtagccctcgctagatgcgtaggcaaagtattttcccatcgttcgcatttactttgcaccctgtgccctggtttcaaggcatgagggctactccttaatgattacatggtacgccctaaaatagggctcacctggaaagatggggtggcaaaacaccacctcacatttttttccgcaacggtggcgacggtcgcaacggtgctgggagtccccctcaaaacaccgtcgcgaccgttgcaagcgtcgcgctttacttgattacttcaacataggtgcttctatcaccacgtaggtcagccggatacgccgcccttcgtgtttgattttgtattcatacttcacctgatgttcttccagcagacgactggcatttacattcagatgcttagtagctttgtgcggataatatgctcctttgtggcccaagtgttttccttgagccgggtcttcatatccgctgtataaagttccacaaagcttttgaagttcatatccagatcagcactggttttatgaacctgctcacgctcccaggcctgcgcctctcgcttagtcttaaaaccgcgcttttgggtctgcttccgctcaccattccaatcggtatagcgataaactgcccgccaggtgccggttttttcttccttgtaaacggccattatgattcctcctttaccgttttggtatagtaatacttctctctgaagaattctcgattgacacggccagagatggtcagataccctttctcctgcaattcttcattaagcccatggatcaccttgtaggcgtgggatttggagatacccaattcctgagcaacttcgtctgctcgcataaaactctgtttttgcataaatgaaataccttcctttccttgctggttgttttttcctgctgattttgtttctcataaagccctcctcactctctactgccacttttttcagattttgcacccaaaaattttgaaaaaattttcttcgggtattacagctaagcaaatatgctttgtttattgtaattatactaagcataatagcttatgtcaatcggcgtatgcaaaataaattaaataaaattgtttagtattctcttgactttcctaagcatttctgctacgctttttataaagacaaccaacgattggagttgacgatatggcgattggtgaacgaattcactttttccgtctcctgcgggggatgacacaaaaatatctcggtatgacgttgggattcccggagaagtctgctgatgtgcgccttgcacagtacgaaacaggatcaagaaccccaaaggcagacctgaccgctgccctggcacaggtattggatgtctcgccccatgcgctctctgtcccggacatagactcctatgtagggctcatgcacaccctgtttaccctggaggataactacgggctcaagatcagcgagatggatggcgaagtctgcctgaaggtcgatgttcggaaaaacaaggacgccgcccggctgcatgagatgctctggacctggcgggaacaggcagccaaactggaggtcggtgagatctcccaggaggactacgaccgctggcgttaccactatccagagtttgacaaggcccagaactatgtgaaggtgccgccccaggatctcgcttgaccatctcacttgtagaccatgagagaggccgtttgttgcacaggacaataataaaaagaaaaagagagctaactgactaatcaaaatcagttaactctctttttatgaataatgaaaaagtgttgccacggagggccttaacccctcaaaaacccagttatatcaggcttttccgggcatctgaaattactcccactcaagtcttgggctttgatttagggttataaaatgtactttaaatacgctttttgtccagatagtccacgtatttcacgctgtgcacaggttctttacgaattttgtagccgttttgtagccagctattttatacgtactaaccgttcgcaacgacttgttttgaatgatttgcagcagatttcgatatgattcccgctaataatcacccggaaattgaccgcctgattcacctcaaaaaacatcctggaggtatgaccatgagcaaacttatatcctgtcaattcaacatagacacagcctgcgtggaattggtttttgacgatggaagccagatttccattgactgcaccgccgttgaaaacgaagttgccgacaatcgcttccagcggtcagagctggattatctgatctacaatgactcgcttgcttatgccgatctgattctgaacagcaagctgaacgtcctgtttgaataaaccgacatgagcataaacgacagcgtcccggttcataatgattgggacgctgcttattatatcattgtattttgcgaactcattcctcgaacagatacagaagatatccgtagccctctgctttcatctttgcgtaaggcacaaagcggagggacgcgctgttgatgcagtagcgcacgccattgggggactccggatcgccggtgaacacatgaccaaggtgagaatctccggcacggcttctgacctctgtgcggcgcatgccgtggctcaggtcctccagttccaccacggcaggctcttcaatgggctttgtgaaagccggccagccgcagccactctcaaacttatccgtggaggaaaagagcggctcgccggtcacgacatccacatagacgcccttttcgaacttgtcccagaactcgcccgtgaaggcgcgctccgtgccgctctcctgcgtgacgcggtactgctcctccgtcagcttgtcacgaatggactccgccgcgggtttttgataatcacccgggtcgatgcgcagccgggagaaaagctccatctccgcgcgcgggatgtggcagtagccgttcgggttcttttcgaggtagttctggtggtattcctcggcgggatagtagttcttgagcggaccgatctccacaaagaatttctcgctgcggccacgctcgatctccgcgatgcgttttaccgtttctctcgcgctttcgttggtgtagtagacgccggtctggtactggctgccccggtcgttgccctgccggttttgtaccgtagggtcgatcacataaaagtaggccagcagcagcgcgtcgaggctcacctgctcggggtcgtattccacccgcacggtctcccgaaagccggtctctcccttgcagacggtcttgtaatcggcgtccgcctcgcaggtgccgttggcgtagccgctctcggcgtcgatgacgccggggatggactgcatcagctgttccatgccccagaagcagccgcccgccagatatatgacattttccgtggtattcatatacatgcttccttcaccggacatatcagagggctgtccggtcatttccttctcgtccgttttctgcggcatatttttctgcccggcagtgcagccgctcagcagcagtaccgcggtgagcagaagcagcaatactctccgatacatggtgtatccctcctttctgagaagataaattcgtttgtcagcccatatcggcggcaagcgcctgatcaatgagcttttgcagcgtctccgcctgcttcttttccgtgatggcgcctacgatgggctcgcccacgatattgccgctgcggtcgaccacataggtggtgggataggcgaagatgttggtggtaaactttcctgcctcgccatcggagtcaaaatacacattctgataagtggcgcccttcttggcaagcacaaccttagcctcggaaattgctgtttcatcgccatccaatgtgaaggtgttgacaccgatgagggagccgcccttctccgccagtttcttgttcagcgcatccagctcggaaagctcgcctacgcagggattgcaggtggtgaaccagaaattcaccacggtgacggcgttggcggagaacagctcgtcgctcttcaccgtgttgccatccaggtccttgccctcaaaggtggggaacttctgcatactgccgtcgtcgggagggttgctcgtgtcgctgcctgcgggtatactcatatcgccgtccatggattgctgcacgatctcagggtacttttcctccagcgcggtcagcttgttttcgatattgctgatctccgtggcggcctccttcagccactcatactccttgtcggtgaactgctctttagcggcctcgacggtatccaacaggaagtcgccgtagttttttccgtcctcgatcatggccatgcccttgtcggcctccataaagaccttttcccacagctcggtattttccgacaggagcgcgttctcccgctccagcagctccttgtgcagggcgagagcctcctcggcggtttttggctcgccggtcatggcggagccgttgccgctcatgtcgcccatcttgtcattgttcttcgtgccgcaggccgccagggccagcaccatcagcacggcaaaagccagtgcaaaaattctcttcatgttcattttgattcctccatcgttgttttctttgttgtttctttcccgctgccgaagccgtaacggaagcacactgctttcgtcggacaagcgcggatgcacattccgcagcggatgcactcggtatggttgggcgtttttgtcacgtccacgtccatcttgcaggctctggcgcatttcccgcaggagatgcacttattcttatccaccttcatctggaagagggacacccggttgaacagcgcgtagaatgcgcccagcgggcagagccacttgcaaaacggccggtagaacagcacactcagcacgatcaccgacagcagaatgctgaatttccatgtaaacagcttgcccagcgccgcccggatgccggcattggcaagggacagcgggatggctccctccagcacaccctgggggcagaggtatttgcagaagaacgggtctcccatgccaacatcgttcacaaggaacgccggcagcaggaaaaccatcaccagcaggacagcgtacttgaggtatgtcaggggcttgagcttctttgtggagagcttctttgtcgggatcttatgcagcagctcctgaaaccacccgaaggggcagagaaagccgcagataaagcgccccagcagcacgcccagcaggatgaggaagcctgtgatataataggaaaagctgaacttggacgagcccaccaccgcctgaaacgccccgatgggacaggctccggaggccgccggacaggagtagcagttcagccccggcacgcagacagtcttccccgccccctgatacagtccgcccttgaggaaattcggcagatgcaggttggtcagcagcgtcgcacccgcctgaatccagccccggaagcgggacatggtctgcgaaacgcctgaaaactttttacccaatgcccacacactccagacatagtttgattgctttgctcagcaccgtcgccgcctcgccccgccagacaccgaaacacagcatggtaattccggttatcagcagcgcgatctgcgccgcggccttttttccgcagctcattttgcattaccctttccgattttctgccctcatcatagcgtaggagagttaaagtctctgttaagaacgaaaacttaacgcaaaccttatctatttttgctataatgaaagcaacacaaaaacgaagaaataaaaaggagggctctcatgcaccttttagtaattgaagatgaacgcgccctgtgcgaaaccatcgtccgcagcctgcggcggctggcctacagcgtggactactgctatgacggggaaaaggcgctggcgcttctgggcgtggaacgatacgatctggtgcttcttgatctgaacctgccgaaaaaggacggcatgacggtgctgcgcaccctgcggcagaccgaccgggagacgcgggtgctgatcctctccgcccgcagcgaggtggatgacaaggtcgaggggctggacgccggggccaacgactatctggcaaagcccttccacttggcggagttggaggctcgcatccgcagcctgacattgcggcagttcacccagcaggatgtactgctaagctgcggcggtctgacctttgacacccgctcccgtaccgccaccgtcaacgggcagacgctgacgctgacccgaaaggaaacgggcattttggaatatctgatggtacatcagggacggccggtgagtcaggaggagctgatggagcacgtctgggacaacagcgtggacagcttcagcaactccattcgcgtccacatctccgccatgcgcaaaaagctccgcgccgtgctgggctatgaccccatccgcaaccgcatcggcgagggctatctgatgggaggcgaggaagcatgaagcgtctttctttgcagtggcgcatcacgctgatgaccgtcctgctcatcggcatcacctgcgtggccatgaatttgctactgtgctcctccggtgtgtactatatggacaccattgcggacagcttacagggcggcagcacggcgatcctgaatgaggacggagaggcgagctttgacccgcggctcatagcgcccaacgaggagttgaccatcgtcgtcgatggggtgcaggggcgcttccgcaccaccaactggtatatcacggcggcggtaacgctgctcagcggcatcctcgcctattttgtcagcggacgcgccctcaagccccttcgcagctttgcctcgcaggtggagcgggtgcagctgaacaatcttgccgatatgaggatcgatgaagacgccatttcggagttccggcagctgagacgctcgttcaaccagatgctggagcggctgaataacgcctttgccgcccagcggcagttcaccggcaacgccgcccacgagctgcgcacgccgctggcactaatgcaggcgcagctggagctgttttcctcagagcaccctgacgtgctaccggagactgcggagtttctcaccctcctgcgcgagcagactgagaggctgacgcagatgaccaagacactgttggaaatgagcaatttgcagcaggtggcacggaatgagcgaatccagcttgctcctatgatcgaggaaatctttacggatcttgcgccgctggcggagaagcgcggcgtcacgctggatgcggagggcgacggctccctgatcggcagcgacgcgctgatctaccgtctgctcttcaacctgacggagaacgccgtcaaatacaaccgccccggcggctcagtgcgggtcgagcttgcacaggggcaggaaaagtgcatcattcgcgtttccgacaccggctgcggcattccggaggaatatcagcggagcatttttcatcccttcttccgggtagacaagtcccgcagccgcgagtacggcggcgcgggactggggctttctctggtatgggagatcgccaatctccatggcggctccgtttgggtggaggaaagctcggacaagggcacgaccatcgcggtggggttgccaacgcaacaatcaacgaagccctaaaacccttttattcgtttttcgccgcttcgcttgccgcccgtttccgttcctcgctgtacggtgcggtcagccggaaagagaagcgtcccttttcaatttcaaactccttgcagcctgtttccgggtcatagcccgtcagcttgcagacggcagggtatttgcggctgtaagcaagcagccgcttcttcaagtcggtgttgtgggtgcggatatggattagcgagtctttctcgtcaaaccatatatcggtggtcttttcctgcttcgtaagccctgttctcataaactctcctttctgcgcccctgttacgcaataggggcatttttcgggtgtttttcccggctcttgacttgaagaaaacggcgattttcaagcaggagcgcgccggacgatgtctgccctgtccgacgcgctcccattcgataaaatgcgttttttccggctctacacaggaatcagcgagcttcgtccctcgtgaccgctttttctttgcgcggatggaagaatctccacagattattgcgctgaatcacatcctcatagctgcggactttcccgcgcagctccgtattttcacgctccaattctgccgcacggagcttgctgtggacagacttataatcagaaatttcctgtttcaaactgtcaatctcagccttgagctttgcaatcagtttgcttgccgcatccaacgccttttgcagtttggattcctttttctctgctgtaacgtacttctttgccagagtggaaagtcggtcaaagtcctcacgctccacggcgactttggatgagaagggaatggacgttgccacgattttttcgatagaccgcacatcgacccgctgattctggattttttcaattttgctcccaagcgttgctgcctgtttttcctgctgacggttctgctctgtgaattctgccagccgcgcctgttcctgctgcaccttgaactgcgtcaccgtcaggtgttcctcagagctgccgcgctcgcctcgctccacatcgtcataccctgcctttcgcatggcggcgaagaaatcatcttgcagaacggaataggattttcggagcacggtttttccgtttgcgttcagcagcggtttcccatgctcatccagcgcgggcttggaatcccactttttgctcatgctgacctgctgaatcgtttccttgaccgtccccaccagcgatttatccttgcagcgttttgaccacaggatttgcttttccacgatgggaatgtagaccacatgaaggtgatagtggtacacgtcctgccccagcgcgtcggacatggcgcggttgcgctcgtcggcgtgcatgactgccgacaggatgtactgctcgccgccgacgatttctattgcggatttgtaagcatcggtgtaaaattgttttgcgaagtcatagccgccgtgattatgaaaataggcggtgtttacgtcaaagaccagctcgccgtagagaaaggcatcctctttcaatccgcgggtggagatgatcccgtcctttttcaactgctcaaacatctccgcatatccggcggtcggtttcttgaaatggacattgaggtgcgttctctccgggacaatatcctgattgacataggattccttttcccgttcgttgtgctgctgcgcgttgccgattttggcagccgtcagcctcatatttcttgcgttggtacgatgaataccgtcgcctcttgccatgggcaattacctcctgatttcagattgcgcaggatggggcagcttccgagggagcacttctgcggaagtgtaataacccactatgatactttcatcctgcggctgcaaagtatgtagggctgatgcacacgctgtttaccttggaggacaactatggactcaagatcagtgagatggacggagagatctgcttgaaggtcgatgttcggaggaacaaggacgccgcccggctgcacgagatgctcttgacctggcgggaacaggccgccaagttggaggccggagagatctcccatgaggagtacgaccgctggcgctaccactacccggagtacgacagcagccaggtccgcgccaagatgccgccggaggatctgatctaaccccctcacttgtaggccacgggaaaggccgtttgttgcgcaaaatcagataattcagataaatgagagcaaaacaaaaaaggtctaactgatcaacaaaaatcagttagaccttttacttatgaataaaaagatgaggatttttaggctactcgcaagccacccgatttttcttttcaaactcaataaatcgggatttggcgagtgctatcaatctgctatcaaatggggaatttgaaaatcaaaaaaccagtgtttatgcgcctttgcgggctctcatatccactttttgcttattcccactcgacaaattcaagtatatgaggaagtatttctcttgaatctacaggtaaagtattcgcaaatttgttaatattttacctgctattttcggctgtcaattttcttagtatcaaaatagtatcacaagaggctggaaaatgcaacagaattatgtggagctctacataattctgtaaccttctttgctgtggcgtatcaagtaatcttactgaacatatggcgcaccttgtccaggcggctgtttggacggcggggctggatgaccggctcgccgacagcggcctgataccctttcagttctgtaagacatacgctccgcccgttggtgtaaaaggccagatcagtacggtatgcctgtatatagcgggcgggaatttcgccagtaaagacaacttcatccttttttacctgggccgtttcgatggtggcacagtattttggcgcatcgtgataagccctggaaaggtattcctggggcgcatagagggtgaaggagagataaggttccagcaactgcgttcctgatttcttcaatgcctgttccaatacaatcggggccaatgagcgaaaatccgccggcgtgctgaccgggctataataaagcccgtattcaaagcaaatcttacagtccgttacgttccagccgcacaagccttgctccagcccgtaacggataccatccatgacagcgttttgaaaactctggttcaagtatcccagggaaacccggctttcgtattgtacaccggagccaagcgggagcggcgtaacagacagtccgatggatgcccaaaacgggttgggtggcacctcaatatggatagtgtggttggctgctttgagcggccgctctaaataaatgacggtgggttccttcaccgctgtttcaatcttgtacttttccgccagcaaagcggaaacaacctccaactgcacccggcccaaaaaagaaagaatgatctcatgggtgatggaatccacctcgtagcgcaaaagcgggtcagtatccgcaatttgcgtaagagcgtccagcaaccgttctctttgcgctgccgttttcggcgcaatcgtcgtccgcagcatggggaggggggcatcacgccacctttcacgagggagccgggtttggtcccccaatacatcgtttaatcccacgctgtcgctgggaaagatgacaatttcgcccttatgggcggtgtctgtccgaacaatttcccctttggatggaatacgcatctctgtgattttcagcttttctctcccggccagggccaccgtatcccgcaggcacagcgttccgctgtatagccgcagatagatgagccgctggccacaatctgtatactccaccttaaaaacgctgccgcatagggcggcgctcccctgttccccaatcggttggaacagccctgtcactgcatccatcaacggttgaatgccaaggccctttttggcgctgccatgatagactgggaacagggaagcggcttgaacccgccgctgttcctcctgcgcaagttcttcctgactgattggctctcctgcgatatacttttccaataatccatcgttattttcgatgaccgcatcccatgcttctatgccggtattttcctccaggactatttccggggacagcgataccgtctgcttgatgataatatcggcggagagcttatcccgaacagactgatacacgccctgcaaatcaacgccagcctggtcgattttgttgataaagataacggtgggaatgttcattttccgcagggcatagaacagaatacgggtctgggcctgcacaccatctttagcggagatcaccaagatagccccatctaaaacagccaaagagcggtacacctccgccaaaaaatccatgtggccgggcgtatccactatgttgactttacatctgtgccactggaaggaagtgactgccgcttgaatggtaatcccacgctgccgctccagcagcatggtgtccgtcctcgttgtccctttttcgacgctccccggttctgaaatggctccgctggcatatagcaggctctctgtcaaggtcgtctttccagcgtctacatgggcaagaatcccaatattgataatgttcatgtctatcctccatgcaaggcccaaatgggcgcaaaaatccccagcggctaatacttttaccgctggggatcatgacttcggacacacaaaaacacacacggcttacataagctgctgtccgtcacgatatttgcttaaaaggcaaaagtattcttaaattgggtacaaaaaccaagcccctgcaaggggcaagcatttttgcgcccattatcaaattttatttaagaataccttgccgcatatttggtagactcctcaaatcagaataataacagtatatcatagtacgctctaaaaagcaagaaattattttacccgattccacaaataaaatcggagggtattcactgaaataccttccggttttggtgattatcgtgcgcctacccttgttttttgccttgcggcccgtttccgttccttttcggcctgttcctgctggtaagctgcctctaatattctgtccgcttgttccagaccaatggcccgcctgacccgctcgtagtccctgacctttccctttagactgtctctctcggcgcagacctcgtaaatcctttctgacaaagaactgtttttgctgacctcccggccatagtccgcttgtagccgctcaaatttggatttgaggtcgagataggcccggtagaccgagcgcagcaccttgacgatcttcgcccaaagaggcttggcctttttctcccggtaggacttggcgctctccagcggccccggctctggtaagacttcctctgggtctgccgaaaactccgccgccagccgttccatgttctttactgccggggccaactccttcaaccgctgttcctgccccgccacctctttttgcttcttggccttgaacttatccagttgggcgatctccttggccctctgctcctttttgtagtccagcacagacaggtgctggtcgtgggtgcccttgtcctcccactctatcccgtggcgctccatcacggcggcaagctgttccttttcagagcgtacccactggctccattctgtgtcccctctggtgccgcccttgaaaccctgggccgctaacgcctgtttaagtgataccctggtgtccagaccccgcttgctgccggtggtgaacggcacaaaatcaatgtgcagatggggtgtggcctcgtccatgtggaggtgagccgagaacacccgaagctgggggttgcgctcttgaaagcccctcatgtactcgtccagcaccgccgccgcaagctggccgtcctcgctgccagcactcatgtcgtccttgttgcccacttgcaggatgatttcgtggaacggcttttcctgcttactggagcgtatcttctcatagtagttctcaatcctgcggtctgccctggtctgcttgtcgttgtaccgcttgagggcctcgtcaaacatctcatgaaaaactgccttgatattttcctggcagtaggttatattcaaatgggagcgttccgggtcggtgttcttggcgttgaacttcctgctgttgtggttcaccgagccttgccccaccatcgcactaatcgtccttttcaaatcaacactcctttcgccgcgccagcggcggcctttgttactttctgcgaaagtaacgcaaaagcacttttgacagcctgtcggccatcaaaagcgcatttgcgccctacggggtggaatgggggctttgcccccgccgtctgcggacggctcccccagcagggccgccctttgaaaaggtcaccctgcaccccgcctaaactttgccactcgccgttgggcaggtgggaaaggcacggcctttcccaccacccggcaagtgttctccgtgggccaaaagtcaaggggtacgggttgtattgccttgcggcaatctccacccgcaggtatgcccccttgacttttgaccccgctccccgtgacggccgtgacgaccgtgacaatgtttcagacaccgcccccgccctcaaaaagccgtcacagccgtcacggtcgtcacgcctgggacggttccagcgtcaggctgatacttctcccggcgtggctcctgctgttctcatagcggatgtggtagtctgtcagcagcttcccggcccggacattcagccgcattgccaaggcgttgggcttcatgtcggtctggagcgccgccgccagttccgtggccgtccctccccaggaggggctttccgccgtcacaagggcggctacggcctccagcaccgggtcgggcggctctgtccatgcctccgtttccgtacgctccagcgtccatatcagccgttccttgtccttggtaagatagaatcgctggtcttgctggtcacgcccggccacgtccagaacggcactgccatctgtccgcttctccttttgaagaagaaaggccccgtccgccgctcccagcagaccgttggtgccggagatcatatcgaatttgtcatctgcctgttgctttcgagtgtggtgtaccagcaggaggcagacgccgcaatcatcggcaaggcgtttcagcttgcccactacctcgtaatcgttggcgtagctatacttctcaccgccagcctcccgtatcttctggagggtgtcaatgataatcagcttggtgtccgggtgttcccggacgaacttctttagctgttcttccaggccaacgccaagctgctttgcgtagaccgcaaagagcagattgtcggtgccctctgtgccgaacaatcggtacagccgcccctgcaagcggcggtggtcgtcctccaacgccagatagaggacagtccccttgtggacagggtagccccacagggggaggcccatgctgacatggtaggcaagctgggccatcaggaacgacttgcccaccttgggcgctcccgcaaagaggtacgtccccggatagagcagaccgtcaataataggcggtctgctcagatacacattctggtaaaggtcattcatggaaaccgtatggagataggctgggtcgctcttgcgccgcatatcccggagcatttcctccaaactttcctcttgggggttgttttcagccgttccctctgctatactttgggtagttgtttgagaattgggctgttccccgtctgttggcgcagacggaatcgggacagtccttttcgtctctctggaatccatcaatctatcaatcctccttcatgccgcccagcgtcaccgagataaggtcaatggtggagagaagttcatcccccacgccgcccccggcctcaatgagccgcagttcctccaggacggcggcgagttggtcacgcagggccttgtagaccctgggattgccctgcaccaccacggcccggtctaagagccgtcgggtgatgtagtcctgcttggtcagcccggagaggcggacggcaatctcaatctgttcattttcctccggggacacccggaacgctatggtcttgcttctccatcggttgtggttgtcgaggttctttacagacatgatttaagccccctttcgctccatgtccagcttgtccgccatctccgcctgccgggtggggaacaggtgagcgtagcggtaggtgatgtcgatactttcatgccccacccggtcagcgattgccagagccgtaaagcccatgtcaatcagcagggaaatgtggctgtgtcggaggtcgtgaatcctgatacgtttgacccccgccgctttcgctcctctgtccatctcccggtgaagataggatttcgtcaccgggaaaatacggtctgtcggctctgcggcatacaggctcttgatgtagtcctccatttcttcacagaggaaagcgggcatttgaatgatcctgttgctcttggcggtcttggggtcggtgactacatcctggcccttgatacgctgataggattttgagatggaaaccgtctgcttctcaaagtcgaagtccccaggggtgagggccagcaattccccctcccggataccgcaccagtagagcatttcaaaggcatagtaggataggggcttgtccatcatagcgtcagcaaatttcagatactccgctttcgtccagaacagcatttcccggcccttggccttgcccatattgcctacctgggcggcggggttggttttcagcttgtagtgcctgactgcatggttgaaaacggcgctcaactgattgtggagcgttttcaagtagacaggcgagtagggcttgccgttcttgtcccggtagttgagcatttcgctttgccatgccatgacctctttcgagccaatctcgctcattttccgcttgccgaaataaggcaccagcttcttgtagaggatatgctctttcgtcccccaggtgttctccttgatacggcctttcacgtccgcagcgtagagggccacgaaactctcaaaggtcatgtccaggtcggcggtctgctgttgcaggaatgtccgttcccactccagcgcctcccgcttggtcttgaagccccgtttcatcttcttttcctttttccccgtccagttctcaaagtaaaaggacgcataccatgtgcctttggccttgtctttgtatgctggcattttgttccctccttactgattttcccgcagtccatagaacttttcctcgaagtagttcctgctcacccgtccggggatggtgaggaaacctttctgcttcagttcctcgttcatctcccgcaccagcttgtaggcgtagggcttggagatacccagcaccccggccacttcctcggcccgtacaaacagttccttgctcatgttttcacctccttgcttctggttcgcaaaattgttaatgcccacgttcttattatacattcgcatggttgttaatgtcaagaggaaatttcgcaattttgttaatttttctcttgcatatttcgcttatttgcgctatactatgttcaaaggcggtggaacatatgacagtaggagaaaaaatcaagaaaatccgaacttttcgaggcatgacgcaaaaggaattggggctggctgtcggttttgaggaaaagggagcggacaatcgtatcgcccagtatgaaacaaactaccgtgttccgaaaagggaactgctggacaagattgcccaggcacttcgggtagagagccagaacttctacacgcttcgccctggctgcgccgaggacttcatgcggacattcttctggctggacgaggacagccccggctccatccgcctgtttcagcttgtccgcaatcccggcaagacgggggcctccgatgataccgccgtccgatacaacgacacggacgactggcccgctcaacctcccgtgggcatttacttcaactatgggctggtagacgagttcatgcgggaatggctcttgcgccagcaggaacttcacgccggggagatcaccagggaggaatactttgaatggaaaatcaactggccgtgtacctgcgatgacagcaaacggtttgactactatgttccttggagaaaagaaaaataggacaagcaaagccgccctgctgaatttgtcgttcagcagggcggcttgcttgccctttgcaatcattctcttgtgtggccgggttgaaacgaatagtatcaatccagtatcacaaggcaaagtgacaggtcaaaaaccctgtattcatgcgggtttgagccgttttgacggttattcccactcgatggtggcggggggcttggaggtgatatcgtagacgatacgattgatgcccttcacctcgttgacgatgcgggtggagatcttgtccagcacatcgtaggggatgcgggcccagtcggcagtcatgaagtcgctggtggtgacggcgcggagcgccagggtgtaatcgtaggtgcggccgtcgcccatgacgcccacggagcgggtattggtgaggacggcaaagtactggttgatgttcttgtcctcgccggcggcggcgatctcctcccggtagatggcgtcggcatcccggagggtgtccagcttctccttggtcagatcgccgatgacccggatggccaggccgggaccggggaagggctggcgcatgactaggtattcaggcaggcccagctcgcggcctaactgccgcacctcgtccttgaagagcaggcgcaggggctcgatgatctccttgaagtccacatagtcgggcaggccgcccacgttgtggtggctcttgattacggcggcgtcgccggcgccggactcgatcacgtcggggtagatggtgccctgcaccagatagtccacccggccgatcttcttggcctcctcctcaaagacgcggatgaactcctccccgatgattttgcgcttgcgctccggctcgctgacgccggagagcttctccaggaagcgggcctcagcgtccacccggacgaagtggatgtcccacttggagaaggcggcctccacctcgtcgccctcgttcttgcgcatcaggccgtggtccacgaacacacaggtgagctggctgcccaccgcctcggccagcagtgcggcggccacggaggaatccacgccgccggacagggccagcagcaccttgccgccgcccaccttctcccggatggccttgatggagctctccttgtagtcgcccatggtccagtcgcccttggcgccgcagacttcatagaggaagttgcggatcatgtccacgccgtgctcggtgtgattgacctccgggtggtactgcaccccgtagaagccccgcttctcgtcggcaatggccacgttggggcaggcgtcggagtgggcggtgagggcgaagccctcgggcaccttggccatgtagtccccgtggctcatccaggagatgccccgctcgggcaggcccttgaagagcttgcaggcggtgtcgtaataggtctcggtcttgccgtactcccgggcggtgtcctcgtgggcctcggtgacctggccgcccagggcgtgggccatgaactggcagccatagcagatgcccagcaccggcacacccagctcaaagatggccggatcagccttgggcgcgcccgtctcatagacggagttggggccgccggtgaagatgaagccgatgggctccatagcgcggagttgctccagcggggtcgtgtagggcttgacctcgcaatagacgccgcactcgcgcacccggcgggcgatgagctggttgtactggccgccgaaatccaggacaatcacggtctgatgggacatcatcttgccttctttctctcgttttctctcacgccatgcccataggcccggcgatatttttacagtttaggataccatattccggcctaaagcgcaagcattccgtaaaaaagccgccggacccggtcaggtccggcggcttttcagcgcagtcttcaatccacttccgcgccgccccactccacggcggtgaagccggtgcgcgcctgggcggttaacgtctggggctccacctccaccggcgcgtccagccccttccacgccaggaacacccggatcagggtatcgggggccgggtcgatggtcagcccggcggagtcggtgtaggcctcggtctggaaggagagcagattgtaggggttgccctccagctttggcaaccagtagatgatgaattcgtcagcctcccgctcggtcaggcccagcctgtccagggcgtcctccaggaaggccgcagtgtcctcccctgccacgcagaagccggcggaaaagtcatactccgcctcggtgatcccctcccagaacaggcagtagtactcccgccccgtggccggattggtgagggtgccgtcgggccgggccgtcactgtccacccatcgccgtacgcaggataggtggaggtcagcgtcccatcaaagtccagagtgacggtcacctccatctcctcctccgggtagaggtagagcaccggcttttccggcaccgcaacatttccactggaattgccgcacccagccagtcccgccgccagcaaagtgagcgcaagcagcaacagcagcttcttcattgcactacctccgcgccgccccactccacggcggtgaagccagcgcgctccggcgcggtcagcttctggggctccacctccaccggcgcgtccaggcccttccacgccaggaacacccggatcagggtgtcgggggccgggtcgatggtcaaaacggcggagcttgtgtacgcctccgtttgaaaggagagcagattgtaggggttgccctccagctttggcagccagtagatgatgaattcgtcggcctcccgctcggtcaggcccagcctgtccagggcgtcctccaggaaggccgcggtgtcctcccccgccacgcagaagccggtggagaggtcgtactccgcatccgtgatcccctcccagaacaggcagtagtattcccggcccgtggccggatcggtgagggtgccgccgggccgggccgtcaccgtccagccatccccgtagtccgggtaggtggaggtgagcgtcccgtcaaagtccagggtcacagtcacctccgtctcctcctccgggtagaggtagagcaccggcttggcggctaaatcgccgcgctcctctgccgctccgcaggcggtgagaccggcagccagcagggctgccagggataaagtcagcagtcgtttcaaagcatttccctcctgtcgttgatattcatttagacgaagggactggaaaaaggttcccggctggccgggtcaattccgccccgccttttccctccgcacggagggaaagaaagcggggaaaatcccgctgcgggagcccagggcatggagcagtgggaagcagaccagaacggtaaccaattgaaccactataacatgattttccgtccgctcctcctgactgtagcgtaccgcttctccggccatgtccacgtagaagtcggtgcggtccaggggatagccggaggtgatctgctccaggaaggcggggtcctcctccaggtcggcccaaatcacccggcccaccgggaggacaacctgcccggatgcgaagttctctccatcctgtacgctctcagtatggatgcgggcagccacccgttccccggaggggagggccaaattatagagatagctgccctcaaaatagcccgctccctcgttgcggtaggcaataccttgggagagcactgtgaaagtatccagctccagcagctccgcgatactctgtgcccggggaacctctggcccggcaggactgcccgcctggccaggagcagcggagtgaacctctgcatagccgtcatacgtggccgcgctgagggcggaggctgcggcccccgtgcccagggacaccagataggccaccagcaggcagagccagatatcaaagcgaaggcggtgcagacgcatggcggtttcctcccctcagatttcagtgatgtcgatggggcgcagctcagcggcccggccctgggtgcggacggtgagcatggcccgggcggtgtcgatggcggtgatgcaggccacggagtgctccacggtggagcggcggatcttgaagccgtcggtgtcgtggcggcggccgcgggtgggggtattgatgaccagatccacggtaccggaggcgatcatatccagaatgttgggatgggcctcggacacgcgggccacccagcgggcggggatgcccgcctcgttgagcgccttgcaggtgccgctggtggcgagaagctcaatgcccatatcatagaagcccctggcgatgccaatcatctcgtccttgtcctcgtccttgacggtaatgatgatgcgcccgcccttcttgggggccttcataccggcccccttgaaggccttgagcagcgcctgggggaaggactcggccaggcccaggcactcgccggtggacttcatctccgggcccaggccggtatccacgtcggtgagcttctcgaaggagaacaccggcatcttgacggcgtagtagtccgcctcccggtagatgcccgtgccgtagcccaggtcgcgcagcttctgccccagcatcaccctggtggccaggtcgatgatgggcacgccggtgaccttggagatataggggatggtacgggaggagcggggattgacctcgatgacatacacctggtcgtcatagatgacgaactggatgttgaccaggcccaccacgcccagggctttggacaggtcataggtgtacttcaggatggtctgtttatgcttgtcctcgatgtggatggggggatagaccgagatggagtcgccagagtggacgccggcccgctcgatgtgctccatgatgccggggatgagcaactcctccccgtcgaagacgccgtccacctccacctcgcggcccatgaggtacttgtccaccaggatggggtgctcctgctccacctggttgatgatgcgcatgaactcggtgatgttgcggtcgttgtaggcaatctccatgccctggccgcccagcacgtaggaggggcgcaccagcacgggatagcccacctcgtgggcggcggccagggcctgctcggtggtgaacaccgtgcggccggcggcccgggggatgccgcactggttcaaaatctcgtcaaaccgctcccgatcctcggcggcgtccacgccatcggcggaggtgcccaggatgggcacgcccatgtcggtgagggcctgggccagcttgatggcggtctggccgccgaactgcaccaccgcgccccagggcttctccagctccaccaccgcctgcacgtcctcggcggtcagcggctcaaagtagagcttatccgccacatcgaagtcggtggacacggtctccgggttgttgttgatgatgatggtctcatagcccagacgcttgaaggcccagaccgagtggaccgaacagtagtcgaactcgatgccctgaccgatgcggatggggccggagcccagcaccagcaccttccgtttctccgcgccatcatccgcccggctggccccggcggcctcgttctcctggtcgtaggtggagtagtaatagggggtctgggcctcgaactcggcggcgcaggtgtccaccatcttgaaggccgggcggatgccgaaggactcccgcagggccttgatctccttctgctcccggccggagagggcggcgatccacgcgtcggagaagcccatctccttggcccggcgcagggtgtcgccgtccaaatgtccgtgatccagggcgtcctccatatccacaatgttctggaagcggtcgaggaaccacaggtcgtacttggtgatcttgttgatcttctccggcgagaagccccggcgcagggcctcggccaccacgaagagccgctgatcatcgatgttcaccaggcggtcctcgatctcctcggtatacagctcgtccagaccgggcaggcggagggacttcaccggcagctccagggagcggatggccttcatcagcgccccctcgaaggaattgccgatggccatcacctcgccggtggccttcatctgggtgcccagggtgcggctggcggtggtgaacttgtcaaagggcaggcggggcagcttgagcacgcagtagtccagggttggctcgaagcaggcggtggtcttgccggtcaccgcgttggggatctcgtccagggtgtagcccagggccaccttggcggccaccttggcgatggggtagccggtggccttggaggccagggcggaagatcgggacacgcgggggttgacctcgatgaccgcgtactcgaaggagtcggggttgagggccagttgtacgttgcacccgccctcgatgcccagggcggagatgatgttgagagaggcggagcggagcatctggtactcccggttggccagggtctgggtgggggccaccacgatggagtcgccggtgtggacgcccacggggtcgatgttctccatggagcagatctggatgacgttgccggcggagtcccgcatgacctcgaactcgatctccttccagccggagatgcaccgctcgatgagcacctggcccacccgggacaggtggatgccccggtcggcgatctcccgcagggagggctcgtcgtaggcgatgccgccgccggagccccccagggtataggcgggccggacgatgaccggatagccgatgcgcccggcgaactccaccgcggcctccacgctctccaccacgtcgctggtgacgcagggctggccgatggcctccatggcgtccttgaagccctggcggtcctccgccttgcggatggactccgggctggtgcccagcaggcgcacgccgtacttctccaggatgccctgctcgtggaggttcatggccaggttcagcccggtctggccgcccagggtgggcaggatggagtcgggccgctccttggcgatgacctgctccacgctggccaggttcagcggctcgatatacacgtggtcggcgatgtccttgtcggtcatgatggtggcggggttggagttgaccagcaccacctccacgccctcctccttgagagcgcggcaggcctgggtgccggcgtagtcaaactcggcggcctggccgatgacaatggggccggagcccagcaccagcacctttttgatattgggattcttaggcatgggcgcgtcctcccttcatgctgtccacaaagcggtcaaacagatactcggtgtccatggggccgggggcggcctccgggtggaactggacggtgaagcagttgggccgccggtagcgcaggccctccacgctgccctcgttgacgttgatgtgggacacctccgccaccgccgggtccacgctctcggcggtaaccacatagccatggttctggctggtgatgtaggcccggccgtgctccagatccttcaccgggtgattgcccccccggtggccgaagcgcatcttgcgggtctccgccccggtggccagggccaggagctggtggcccaggcagacggcaaagaggggcagctcactctcatagagcttccgaacctccgtgatgatctccacgttgtccgccggatcgccggggccgttggagagcatcaccccgtcgaacccgccggagagcaccgcctccgccggggtgcgggcggggaacaccgtcacctcacagccccggttctggaggcagcggatcatgttctccttcacaccgtagtccatcagggccacccggagccgccgctcccccagggcggggtacacctgagcctccctgcgggtcacccgctccacggtgccctccacccggtaggcccggatgcgctccaggcactccgggacagaaaaatgctccgcacaggtgatcatgccgttcatggtcccctgactgcggagtattctcgttaaggcacgggtgtcgacgccctcaatgccggtgatatgaaattgcttcaaataggaatccagcccgtcctcgcagcggaagttgctgccgcgccgggccaggtggcggacgatgaacgcctccgcccaggggcgggtggattcgttgtcctcgtgattgacgccgtagttgccgatgaggggatagctcatcacaatgccctgtccggcgtaggaggggtcggtcaggatctcctgatagccggtcatggaggtgttgaacaccatctcgcagatccgctcctcaccggagccgatgctgcggcccgcgaaggtcataccgttttccaggatcaaggtcgctttcatcttctgcatcacgcctttcgttcccaagttatctgtacgattgtaaccgaaaacctcccgcctgacaacacccttttgcgcccggaagcaaaaaccgtggatttggacaaaaagagagggcgtattgccgattttcccacggcaatacgccccaaaagttaaaaataagattttgacctcattctttttttgcaggaaattcctccagcccggggcgcagctccaccatcaccagctccgggcggttatagaaccggggcagccgggtgctctcccgggccagcccccggctgacgagcagggtggtgtcccccagtgcataccggccgccggcgtaggtgggaaacagcccctggtcgggggcaaacaggccgttgagcaggccgggcagccgccactggcccccgtgggcgtggctcgccagcaccagctcgaagccccggcccgcgtagtcctccgtccgctccggccggtgggtcatcaaaatggagcagtgctccccatccagggcggcggtcaccgcctccagctgctcccgccaccgggtctcgcccacagagggatcgtcaatgccgcagagctgcaccgtctgtcccgccgccgttaccgtcacacagtcccccgccagcacaaccgcgccccgttcctccagccgggccttcacctcgtccacccgccccgtccagaactcgtgattgccggtgacataataggtgggccataccgccgccagggcctccaccgtgtccagcgcccgcgcctccggcatccggggctcgtcgtccacgatgtcgccgcacaacagtaccaggtcgggtgactgctccgccaccgcatccagcagctcccgctggccctccccataggcgcaggcgtgcagatcggtgagcaccgccagccgcaccgggccggtgagtctcccgctctccaccgtataggcgcgtaccagcaggcgggcgtccagacccgccagcaaaaacaccccggctgccgccagagcggcggccagcactcctttcgtccgctttttcatgcgttcgccgctttcttttattgattttcgatattataacatccataccctcccagcgtcaaggcccctgcgtacataatccgcccggcggcggccatactgaacggtgaacattaccgcgggaggtcttctcatggtcatcgcatttctgcgcaccatcattctctacctctttatcatcgtgggcatccgcctcatgggcaagcgccaggtgggcgagctggagccctcggagctggtgctcgccctgcttatcgccgatctggccgccgtgcccatgcaggacttcggcatccctctgctcaccggcatcatccccatcctcaccctcctctgcctcaccatggccctgtcggtgctcaccatgaaaagcgtccgcttccgtgcggtgctctgcggccgtcccagcatcatcgtggaaaacggcaagctccaccagcgggagatgcagaaaaaccgctttacagtggacgagctgatggaggagctgcgtatgaaggggatcaccgacctcaattccattaaatacgccattttggagaccaacggacagatctccgtcctcccctacgcggcccagcagcccgtcactgcggcccagatggagctgcacccaaaggagcccggcctgcccctggtgatcatcaacgacggccgggtgctggagcacaacctgcgccagcggggactggacgacatctggctggaccggcagctcaaggcccatcacgtaaagcgcagccaggacgtgtttctcctcactgtggatgagcagaaccaggtctacctggcggagaaggaggggcgggtatgaagcggctgtggatcgcagccctgctgctggctgtcctgttcggcgcaacgctgtgcaacaacctctatctgcggggctttaccggggcgctgaacgcccttctggagcaggcggaggcccgggcggagaccggggactgggaggaagcccgcgtcctcacagagcaggccctcacacagtggcagtcccgggacagctacctgcacatcctcctgcgccattccgacaccgatcagatctataccggttttcaggaggtgctcgagttcctcacctgccaggaggccggggagtactccgccgccaacgcccggctcatgacccagatctccctgctctacgaggccgaacagtttaccctgaagaacgtcctctagccccggttgacgggccggggaaaacccggtacaatggcgggtgaaaggaaggctgatgcccatgaacacacccaccattctgctctacaatctggacaacccccggggggccaaaatccgccgtatgtgcctgtccctgcgcctgcgcaccgccctggtgcccagggagtcctacggcctgcccctgggggcgctggcggagggggccgtcccggagacgccctattccggggacggctttgacgacgagatgctcctgatcgtcaattgccccggccctctgctggatctgttcctccaggcgttccgccgccagaagctcgcccccgtccggctgaaggcggtgctcacccccaccaaccgggagtgggactccgtggccctccatgccgagctgtgccgggagcggcaggccatcgcagagggccaggccgcccatcggaagggacaggacggggaatgaagctgctcatctcccccgccaagaaaatgcgggaggacggggactttctcgccccccggcaggcccccgccctgctggagcgggcggcggtgctggcggagtggctgcgggggctggactacacagccctgaaaaagctgctcgcctgtaacgacggcatcgcggagctgaacttccgccgctttcaggagatggatctccgccgccccggtacccccgccctgctctcctacgacggcatccagtaccagtacatggccccccacctgttcacccggcctcagttcgagtatgccgagacacacctgcgcatcctctccggcttttacggggtgctgcgccccttcgacggcgtgctcccctaccggctggagatgggggccagatgcagcacccccttctgcaaaagcctctacgacttctggggcgattccctgtaccggacgctgaccgccggcggggaggacaccctgctcaacctggcctcggcggagtacgccaaagcggtacgcccctgggtaacccctcccgtgcggtggatcgacgtgaccttcggcgagacggacggagacaaggtggtggagaagggggtctatgtcaagatggcccggggggagatggtacgcttcctggcggagcggaacgccgaaacgccggaggcggcccagggcttcgaccggctgggctaccgtttctcccccgcccactccaccgccgcctcctacgtatttttgcgggaggggcgggcgaactaggaggtctccatgctccaacgtctgctctgtctgctgctgggctatctctgcggctgcttcctcaccgccgagttggtggcccgcgcccgcaccggcaaaagcgccgccgccctgggcaccggaaaccccggcatggccaatctggcccacgagctgggaaagggctggggggcggtggtactggccggagacatcgccaagaccgccctggcctttgggctgtgccgggcgctcttccccgccctgggcggcctgtccggcctgtgggccgggctgggtgcggtgctgggccacaatttccccctctggcggggcttccggggcggaaagggggtggccgtcacctgcgccgccctcatcctcttctcccccctatgggggacggccgcctgtctgtccggactggccgtcaccctgctctccggctggctgcccctgggggcggtggtgatccccgccctgtttgtccccccggcctttctctgccacggccgggaggccgggctgctggccctgattctggccctgatcatgctctcccggcacatccgggggctgggccgcatcctccggggggaggaggagcggaaattccgcggccgctgagccccttgcggggcagccgaaaaatattgcgcattctaccattccgccggcgctttgtggtataatggtggaacaacatagaacaagagggattccgccatgcacaatgaactgaccaaaaaagacattcaaatgatgaaggaagagctggactaccgccgcatccagctccggccccagctcctggatgcggtgaaggaggcccgggccttcggcgatctcagtgagaacttcgagtacaaggccgccaagcaggagaaaaaccgcaacgagagccgcatccggttcctggagaacatgatcaagaccgccgtggtgctccccgacgccggggccagcgacggggtgcagctctacgacagagtcaccgtctttctggaggacgagggggacaccgaggtgtaccaggtggtcaccaccatgcggcaggacgccctccacggccttatcagcaaggagtcccctctggggaaggccctgctgggccggaaggtgggggagacgttccacatccaggtcaacgatacctacgggtatgacgcggtggtgaaagccatcgagaagggcgccgacgacggctcggtgccgctgaaccgcttttgaaccaatgaaactgtcccgcgccggatggctccggcgcgggacagttttgttattccacccgcatttgcagctcggtgacgtactcctcctcccggttggtgtcgtgggcgtccacccggtacagctccaggggcggccccgccgggcggcggcccgccgccgcgatccccgccagcaggacgccgcagtgctcctccaggcggtcataggccccacggtaatagaggcaggcgtactcccccgccgggagggcgtcgtcatggggcaggcccggctccgtgaggaagaacacccgggagaagtggttatacactccccgggacagccactcctcatccaccgccgcccccatacactggctgccgatgattttgagatagtcctggtggcggtgctccagctttttcagcaggaagtcgatctctttttccaggatgatgtcctcctccaggaacacgtagggccgcgcctcctcccggcggaagaagacccgtccgtcctccgcggcgcggtactgctccagcctggcccggcgggcccgcgcctcctccagagccgcctccagctccgccatgcggcggcggagcagcgcctcctcccggtccagcagggacagcgtctcccccaccgaccggcgctccagataggcgcggatggcccgggttgggattttcagctcccgcagggcacggatgatgttgagggtacacacgtcctgaatgccgtacatgcggtagcggttctccccccgcaccgggtggagcagccccttctcctcataatagcgcagggtgtcggggcagagatcaaagagcttggccagctcgtggatctgataaaattgcttcaacttttttccctccggctcttgactttcggatagtacgagggtttaacatgatcttaacaagagggggttatgaacttgaacctggtacgccgctttttcaaattcaccgttccatccattgtgtccatgtggatcttctcgctctactccctggtggacggcatgtttgtggcctggggcgtgggagagcacgccctcactgccgtcaacctgtccctgcccttcgtgtccctggtgttcaccctgggcatcctactggccaccggcacctccaccgtcctgtccatcgccctgggacagaaggacgtggagcgggcccgcaactactttaaccagaacctgttcgtggtcatcgccgccaccctgctcctggcggtgctggtcctgttcaacctggactgggtggcggacttcctgggggccaccggggaaaaccaccacctggtaaaggagtacgtgggggtcatcgcctgcttctccgtttttttcaccgtgtcctacaacctggaggtccaggtcaaggccgacggcgcgccccatgtcagcatcatcggcgtcatctcctgcggcctgatgaacgtggtgctggactacatctttgtcatgcatctccactggggggtgtggggggcggccctggccaccgggctggcccaggccacgtccacggcggtgtttgccgtctattttctcacccaccgctatcccctgcggttcggccggttcaagcccgaccccggcgcctaccgccgcattatccccctgggtaccgccgacggcctcagcgagctctccaacggcatggtcatcttcctgttcaaccacatcatacagcgtgtcatcggccccgacgccctggtgtcctataccatcatcagctatgtgaataccatggtgcttaacagtgtgatcggcatcgcccacggcatccagcccctgtgcagctaccacctgggggcggaggagcggccggtgtgccacaagttcctcacctacggcatccgcctggccgcctgcttcgccgccggcttctttgtcctgtgccaggtgctggccggggcggtggtgggcctgttcctccagccggacagcgccctgttcgcctcctcggtgtccgctctgcggctgtactccttcgccttcctctttgtgggcttcaatgtggtgacctccggcttcttcaccgccatggagcaccccatcccctccctgaccatctcctttggccggggcctggtgctgatctccggctgtctggtggcgctcgcctttctcttcggtgccaacggcatctggctctcccccctggtgtccgagtccctctgcctgctcattaccctgttcttcctgatccgctacttccgccgggttcgtcgggaggccagcggggagagggatgggataccggatgccaggccgctggactgagcctccccgccacctggcaaaacggcgcatggcaaaaggccatgcgccgcagcctgtcggaacattctttccgacaggctgttcagactttttgaaacttcattccgtttcaaaaagtcatttgatccaacgcgaaagggaaccctgacggttccctttcacactatccttcccttcgaacgcctccacaggaggatttcttggcaacctccggcgcatggcaaaaggccatgcgccgtttctgatttattccgtcaggagccagcgctccaccgccatgccgacgccgccctccgcattggaaccggtctcatagcgagcagccttcttggcctccgccgaggcgttagccatggcaaaggaccatcccgcccaggccagcatctccaggtcattgcctgcgtcgccgaaggccatgacctgttccggccccagccccagccgggcgctcagggcctgcacggcggtccccttgttgacgccgacggcggtaaactccagattttctgcgaaagaggtgaccatctccagcgcgccgcaggccgccgcccgctccatcagggactttcgaccctccggcggaacatggaacacatggatcttctccaccagccggccccgcagggcggcgttcagatccgccggaaagcgggcgtgctcctgaagcacccgctggaactcaggggaaaaggtatgggccagcacgccctccagccggtcccgctgaatccagctctctccctcgcaatagacctcaaagggcacgccctcttccagcagcagctccgtcagcgcctgccgggtctcctcgggaaggcagttgcggtacagccactcccccgtgcacacatccagtacggcggctccgttggacagcaccgcgtagcgcagcacgcccaactgctccgccacctcgtgcagaaacccccacggccggccgctggcgacggccaccgccgccccccgctccgacgccgcccgcagggcgcggatattccgcgccggcaccgtggcgtggtcggcccccagaagggtgccgtccatgtccaggcagatgagcttgatgtccgtcatttcttccgcttcaccgcatggcgcaccttttccgcgatgccctccggggtgaggccgtaggcctccaggacagcctccgccttgccggagcggccgaacacgtcgttgacgccgtggcgcaccaccggcaccgggtagtgctcggccaggaactccgccaccgccgagcccaggccgcccaccacgttggcctcctcggtggtgacgatggccccggtctccagcgccgccttgagcaccagctccccgtccaggggcttgatggtgtgcatatccagcacccggacggacaggccctcttccgccaggctctccgccgccttcagcgccatctgcaccatcatgccggtggcgattaccgtcgcgtcagagccatcccgcagggtgacgccctggcccaggtggaaggtgtaaccggggatggcgtcggtgacactctccaccgccaggcggcccagccgcagataggcggggccgtcatagtccagcagagcgcgcaccgcctgccgcatctcggggccgtcgcagggggagaccaccatcatgttggggatggcccgcatgatggcgtaatcctcgatgcactgatgggtggcgccgtcctcccccacggacaggccgccgtgggagcccaccaccttgacattcagccggggataggcgatggagttgcgcacctgctcccacgcccgcccggcggcgaacatggcaaaggtgttggtgaagggctttttgccgcaggcggccaggccggcggccacgccggtcatgttggcctcggcaatgcccatgttgtaaaagcggtcgggatgggccttggcaaagcccttggtcatggtggagccggacagatccgcgtccagcaccaccaactccgggtattcttccgccagggccaccagggcctcgccgtaggccgcgcgggttgcaatcttctcagccatgcttacttcccctccagttctgccacgcgggcggacagctccgcccgggccttctcatactgctcggcgttgggggccttgccgtgccagccgtagtccccctccatgaaggacacgcccttgcccttcaccgtcctggccaggagcaccgtgggctttcccttgcaggccgcggcggcagcaaacgcctccgccagggcggcgtagtcgtggccgtccacacggatgacgttccagttgaaggcctcaaacttctgatccagcggctcggagggcatcacgtccgccgtggcgccgtcgatctgcaggccgttgacgtccaccacggcacacaggttgtccaggcggtacttggccgccgccatggcggcctcccacacctgaccctcctcgatctcgccgtctcccagcagggcatacacccggtagtcccggccgtccgccttgcccgccagagccatgcccacggccacggaaattccctgccccaggctgcccgtggacatatccacgcccttgacgtggcgcatttcggcatggcccgacatgtgcccttcaatgcggcggaactgcttcagctcctccagtggaaaaaagccccgctgggccagagtggagtagagcgccggcgtgcagtgccccttggagagcacaaagcgatcccgctccggggcctgcggagcgtcggggttcacccgcatcacgtggaaatacagggttgtgaggatatccagcgacgacagggagccgccgatgtgtcccgacgccgcgccgtacaccatatccagcgccagcagccgggaacgcgccgccgtcaatgccaggttttgaacctttgcctgttccatccgattcacctttcccatttctcagcccgatggccgtattttgaactgtctgtattaagtatatcgtaccaggcccgcgctttcaactggcgaactgtaaaaaacattggtttctctgcgcggctttggggaaaaaggggggccggcagggcgcgcaggcgcccccggccccttatttctagtggatgttcttcatggtcatccagcgcttcgagcggtagaaccaccagcccaccggcaccgagctggccacggcgacgccgcaggcgatgtagacgccgtagatgcccaggaagtgctccaggacgacagccaggatcagccgcaccacgatgcagttgaggaaggagttccacatgatgaacactgtatgccctgagccggtggccagggtgttgtaggtaaacatgccggcgtagaagagctggcagacaatctcaatacgcaggttgaccaccgcccagtgctgcacctccgggtcaggggtaaagatcatggcaaactggggggcaaacacctcggccaccacgataatcaccgccgccatggccagggccagcttcatgcaggtcttcatcacctgctcggcccggtcatagaggcccgctcccaggcactgggcgcacatggtgcccgcgccggtggtcagggcggagaggaagagctggcagaagtcgcggattttgttggacacgccgttgccggcggagacggtgacgccgtacttgttgatgagggtgagcaccaccagccaggagatggaggcgatggtccactggagggctaccggaaagcccagcttcagggtgcgtttgaccatctccgcctcggggcggagatagcggggcagcaggcccagatccgcccggtggcgcagggagaacaccagagcggtcaggcaggatatcgcctggccgatcacggtggccagggccgcccccgccacccccatgtggaaccctgccacgaacaggatatccagcaccacgttgaggctcaccgacgcaatgatgcagtacagcgggatgcgggagttgcccaccccgcgcaggatggcggagagggaattgtagacaaagatgaacagcaggcccacgccgcagatgctcagataggcggtggcctcctccagggtgggggactggagcaaaatcagcagcggacgtcccagcagcagaatgcccacagcaaagagcaggccggcgatgaggcccacggtgagcatgttgcccgcggctttccgacggttctcgtggtcgccgctgccgaaatactggcccaccagcacattcccacccactgtcagcccaatggccaattgggtgagcatattcataatgatgctggcgttgttgatggcggaaattcccacatcaccgatgtagtgcccggcgatgatgatgtccgtaatactataaatagcctgcagcaggctggacgccaccagtggcagggcataccggaccagcttgcgcgtgacgctgccctgggtaagatcctgttctacagcgggcatagcgtaccccctccttatatgcgttcaattccccgtttctttacacgttgttaaagtttactgcggatttcctggcaaggcaatactaacttttttgtcaccaccacacaaaaacggacggcttccgccgcccgtttccttataattccctataataacgcaatatacgtttactcctcgccctgttccacgccgcgccggcgctcccgcccgggccagaagttgttttcccgcatgatgtcacccagtgcgtccacatacttctccgacttgtgcactacaaaggcatccgcatcgatggggattctgcggtcgtgcatctggcggatactccagatatagagtatgtccagggcagggatgagctgctccccgctgggtgtgagcacatactccaccttgggcggcaccgtgtcgtaggagatgcggcggatcagccccgcctccaccagctccttgagctgctggctgaacaccttttccgagatgggcaggattttaagcgtctggttaaagcggatactgccgtacgtatagatttcatggagaatggtcatcttccactttccgccgatgcagtgcaacacatagtgatagggattagtcggtgtgtcaaaattgtccgctttcacaggcgttcacctcattttcttttgtgatacaactatataaagatagacctgcattatcatatcacacccccaccactcccacaaggaaaactttttccgccccactgtaacgcgccaaaattttttgctgaaatttgtgcaacctatccaacttccacagagatacacttttgtaccgaatagtttacacaatatccctttttctcttttattcgaattatacaatttcggagcacttaccttttggtacgtgcaaacctacaggttatctacttacataattgtgggtattgcacaaatttttattttccgatacactacggctcgaaaaggaaagcataagttccaattcatcgcattggtttcctgaaaatgctgacataagaaggagcggatttcaaatgatcaagcgtacttatgaagagctggagccctatttccccgccggtcattttggcgtgacctgcaagcgctaccacggcaaggacgagaccggcgcccagaagttctggatcggtgtgtccgagttcgagcccgacggcggtgctgactgggcctacgacgacaaccccctggagaaggtctacttcgtcctggagggcgagatgaccgttaccgacaaagacggcaacaagtacatcatccacaagaacgagtccatctccttcccccccaacgagggccgcggcctgaagaacgagagcggcaagcccgccaagatgctggtcatcatcaattatcccgacgcgcagtaagtaagaggaggaagcagaaatggtcaacgtgaagaaagagttcgtcgacaacatgttctccgtgaagggcaaggtcgccctggtcaccggcgccaccggcgctctgggctgcgtcctctccaaggcttacggttatgccggcgccaaggtgttcatgaccggccgcaacgagaagaagctccaggctctggaggccgagttcaaggccgagggcatcgactgcgcctacggcgtggccgatcctgccgacgaggcccaggtagacgccatgattaaggcctgtgtggcccagtacggcgaggtcaacatcctggccgtcacccacggctttaacaagccccagaacatcctggagcagtccgtggccgactggcagtatatcatggatgccgactgcaagagtgtctatgtagtgtgcaagtatgttgcccagcagatggtcgaccagggcaagggcggcaagatcgtggtggtcacctcccagcgctccaagcgcggcatggccggctacaccggctactgcacctccaagggcggcgccgacctgatggtgtcctccatggcctgcgacctgagcgccaagtacggcatcaacgtcaactccatctgccccaccgtgttccgcagtgatctgaccgagtggatgttcgatcccgagtccgccgtgtatcagaacttcctgaagcgcgagcccatcggccgtctggccgagcctgaggacttcgtgggctacgccctgttcctctcctccgacgcctccaactacatcacgggtgccaactgcgactgctctggcggttacctgacctgctaagcctggaaggaagtcgagcagcatgaaagaaatcaagaacattctcatctgcggcgcgggcatgatgggcaagaacatcggctatgtgtttgcgtccaaccccagcttccaggtgggtatgtatgatctgtaccccactgatgtggaggcgggcatccgcaccaacaccaggcagctcctggacaagggcgtcatcaccgagcaggagctgagcgaccgcctctcccgcatctcctttaccaacgacatcgacagcgatctggtgaagaatgccgatctggtgatcgaagccgttttcgaggacatgaagatcaagcgggagaccttcgccaagctggaggcgcgctgccgccccgacaccatcttctgcaccaactcctctgtcatgagccccagcgagatctccgccgagctccagcaccgtgagcgctttgtgggcactcacttctggaaccccggccacctgatccccctggtggaggtggtcaagtccgacgcctccagcgacgaggtggcccagacggtgatggaggtgctgcgctccgtgggcaagaagcccgtgctgtgcaaaaaggacgtgcccggcttcatcgccaaccgcatgcagcacgccctctggcgggaggccatctccatcgtggagaacggcatcgccgacgccgccaccgtggacgaggcggtgcgctactccttcggcctgcggctgccccagctcggccccatggagaacgccgacatggtgggtactgacctgacctataacatccacgactacatcctgcgggatctggaggactcccacgagccctcccccctgctcaagcagctccgcgacgagggcaagatcggcttcaagaccggcgagggcttccagaagtggacgcctgagcaggttgcccagtccaacgccgagctcaatgagtatctgattcggatgctctacggaaagtaaaaactttccctttccttttgtcccacactctgctatgattatccaaggaggaactttatcatgggtaaaaaagtttatgtggacctgacccatcccttcagcgcggagattccccgctggccctactttgacaagcccgagatcaccaacgcccacaccatggccaagggcggcgtgctcacctccaagatcacctgcaccatgcacaccggcacccactgcgacgccccccgtcacgtcatggagtacgagtttgacggccgccgcgcccgctacacccacgagatgcccattgatgcctacaccggcgaggctgtggtgctgaagctggacgtggagccctggaccctgatcaccgacaagcacctggacgaggcctgcaagaagtgcggcatcgaccccgcctccctgaagggcaaggttctgtgcctgaacaccggcatgcaccgcctgttcgatgactccaaggcctactatcactactccatcggcaccggcatcgacgccggcaagtggtttgtcaagcacggcgtcaagtgcgtcgccatggacagccaggccctggatcaccccctgcacaccgccatgggcaacaacggcatgacccgcatgaacctgctgggcgccaccggcaagcccatcaccgaggagtacaaggagttgttcggcgaggaggcctatgccgagttcgacaagttcgagtacatccgcatccacggccaggccgcctacgacgagaagttcggcgagctggaggatctgggcgtatggggcacctgggagccctgccacaaggagatgctgggccacggcatcgtgggcgttgagaacctgggcggcgatctggacaagatcaagccgggcaaggtcttcaacttcttctgcttccccctgcgctggtacatgggcgacggcgccatgtcccgctgcgtggccttcatcgacgaggacgacgtggacgccagcgtgcccgaccgcacctacaaatacggcggcaccggctacgccgatgagtccggccacggcgacagcggtctggagtacatgcgcaagctgttcaaccgcaacaagtaatgcaaccggattgagttccacccataccgtaaagcggcgtgcgctatgcccgccgctttacgtgatgtccacaccaaatggagaaaggacctgaattccatgagtgagctgaagaacaagacgatcatcactgtggccactacgggcgcctggcccaccaaggccaacaaccccaacgtgcccatgaccccggaggagatttccgaggacgtgtacgcctgctggaaggccggcgcggccatcgcccacctgcacatgcgggacgacgaggggcacggcaccatggacaaggagaagttccgcaagaccgtggagctgctgcgcgccaaccaccccgactgcgacatcatcctgaacatgaccacctccggcgacatccacgccgacgacaccacccgccagatccacctgaaggagctgcgccccgagatgggttcctatgactgcggctccatgaactggctgcacacctccctgttcctcaacccccctgccttcctggaggagctgggcaagaacatgcaggagtggggcgtgaagccggagattgaggcctttgaccccggcatgattgccaacgccgcctactacctgaagaagggcgtgctgaaggccccccttcacttccagttctgcatgggctgcgccaacggcatccccggctccctgaagaacctgatctttatgaaggaaaccatggagtccctgtgccccggctccacctggagctgctttggtgtgggccactgcgcgttggagatgctgtacggcgctgtggcgctgggcggccacatccgcgtgggcatggaggacaacgtgatgtacgccaagggcgttctggccgagagcaacgtgcagttcgtggagcgcgcccgccgcgtcatcgaggagtacggcaagcaggtcgccacccccgccgaggcccgcgagatcctcagcctgggcaagtaaaacatatcagacaggaaagccctgcaggcagaagcttgcagggctttcctcccgaaaaaaggttttcaacaggcggaacgtcgtttgacccaatgtgacaggaaaccctgacggttccctgttacatgacctttcccccgaccccctcctgtagaaggatttagcgacagtctggcttttttccgtcccgccgttgtggtatactgaaaaaaacgacgagaggaggacccgcgcttggaatccctggaggcccttttggaactgctcacccccctggcccggctgggccgccccgcacttgccgccatcgacggccgctgcggcagcggcaagagcaccctggccggactggcggcccacaggctgggctgccccctgttccacatggacgattttttccttccgcctgccctgcgtacaccggagcgttatgccgctcctggcggcaacgtccactatgagcgggtggaggcagagctgctgcgccccctgcgggagaccggtgcggcctgcttccgcccctttgactgccgctccatggacttctccgcccccatccgggccgagctcaccggcctggcgctggtggagggcagctacgccctccaccccgccctgcgtggctggtatgaccgcaccgtcttcctgacctgctcccccggcgagcagcggctccgccttctggcccgtgagggcccgaaacggctccccgcctttttagagcgttggattcccctggaggaggcctatttccagtccaccggtctgcccggagggtgtgacctggtgctggacaccaccccctgataccgcaaacagcggcggaacggatgctccgttccgccgctgtttcagcctgtcgaaagcttcttttcgacaggttgaaggaccttttgatgcttcaaaaagtcctttgatccaacgtgaaagggaacccctgacggttccctttcacgctatccttccctccaaatccttcggccgaagggtttaccgaccgccgccgcttactttatacctcaccaggccagccgattttcagggtcataccctcctgtcccacacccgcgctgcgggtgatgggcaggcgctgctcctccgagaagccgatggtctcgccatcccggagggtcacgtcctcctccagcagataatccgcgatgttcaggaggaaattccgcacctcggcgggctcggccctggcgtccagcacctccagttcgtccttgccgaagctgcgcaggccgtcggtataggcgcccatcccctcctccgtccggtagaggcccacccacaccagattgagcaggggcagctctccctcgtccagcggggcggccgcctcctgatagagctccggcggatagaccgtaccgttggcgtacacacccagagtccccgcctgcccgcaggcggcgcacaccagcttcacctggagggcggcggccttccatggcccggcctcccggcccaacaccgacaccaggagctgccccttgtgccgccgggcagccgcctcggcctccggccacaggtagcaccgcccggcagcctcctccgcctcgccgtggggcaccgggaaggggtagaggctcagggccgccagcatcccctccacctcaaagaccagggtgctctccccgtcctccccatcctccggctcggtcatgcagggaatgccccagtggtcccgcagcgcccgcttgaaggcctcggggtcccactccggctcctccagcagcacgaaggccagaaaattccccgcggagccgggctgctccagagcgggctgcccctcctcccgcaaagagaagtcggccccgaacagcaccatctggctgtgcccgcccccctggaaacacagccgtagcccctggtcccgctggatggtgaaccacgccagctccagcccgtcggtctgcagctccgccctcagctccaggaaggttctgccccgtcggtccagctcgggcaggcgggccgccagcgccgccgcccactccgcggacagcttggacagggcggcctcgttgccgaaaaagcggccctgtaccgtcccctctccgtagggcatggtgaaagtgcaatagggggcgtcggcctcccactccgtcacgcccagggccgccttgacggcctccagattggcccggtcgcagaggatacaggcgatggccaggcgtttgtccgccatctccccctcctccgcctctccggcctggagccgccggtcctgctccgggtcgatccagtggtactccatctcctccaggctcctgccctcccggatctcccgggccagggtggtgaactcatagtcccccggctccagggccagcccccgctccactgcggccagggccccggccgtgtcaccaaagtggctgcgcagcttgcccagttgtagccagccccacacatagtccggctccaccgccattcccttttccgcgtaggccagggcctcctccagccgcccgcagtacagcagggcgcaggagtagcggtagtaccacatgctgcagcgggcggcctccgcgctcccctccgacgcggccatccactgcgccgcccggcagtacgactcatattcgtccaggttgttgcaggcgtaggagtaccagagggccgtctccaggtcggcctttgccgcctcctcggagaagcgcccccggcgcacgccgtcctccacccgcttctccaggtagtccagcatcttgtaaaagtaccctgtggagccgtcgctcatggcctccaggttttccacatcctgcggtgacagtaccaggctctccatatccatccccctcgcaaaataaatataatttataaaatctgtttttattataacagggcgtccctcccctggcaagccccattccggcggggcgcgggaaaagccgggcgcaattcccctatccccttgcatcctccaccggaacgtgcgataataaactgaaatcacccgtttaatcaaaggaggttcccgcatgaagcccacccaagcctgccgccctgaaaacctgcactatctgaaaatgctggcccgtcagtaccccacggtccaggccgccagtacggaaatcatcaacctgcaggccatcctgaacctgcccaagggcacggagcactttgtctccgacgtccacggggaatacgaggcctttctgcacatcctcaactccgcgtccggggtcgtgcgggaaaagctggacgatctgtttgccgccaccgtctccaaggcggagcgggatcagttggccaccctgatctattaccccaaggagaagctggaggagatccagcgggagacccccgacatgcgggagtggtaccgcatcaccttccaccggctcattgagatctgccgcctggtcagctccaagtacacccgctccaaggtgcgcaaggccatgcccagggagtacgcctacatcatcgatgagatgctgcacacccactacgaagacaacgacaagcgggactactacgagaacatcatctccaccatcatcgacatcggccgggcctccaacttcctggtgcagctctgcgagctcatcaagcgcctggcggtggaccacctccacgtggtgggggacatcttcgaccgaggcccccgggcggacatcattctggactccctgctggactaccacagcgtggacatacagtggggcaaccacgacgtgctgtggatgggggcggcctccggctcccgcaccctggtggccaccgtgctggccaactccctgcgctacaacaacctggaggtcatcgagaccggctacggcatctctctgcgccccctgtccgtctttgccaacgaggtctaccgggacaccgacgtgacgcgcttctccgtcaagctcaccggcgaggaggcggagcggtacaccgaaaaggacaagctgctctccgcccggatgtataaggccatcaccatgatcctcttcaagctggaggggcagaagatcctgcgcaaccccgacttcggcatggccgaccggctcctgctggacaagatcgactacgaaagcaggactgtgacggtggacggcagggcctatcccatgctggacaccgacttccccaccgtcaaccccgccgacccctacgccctcacccccgaggaggagatcctgatccaccagctcaccctctccttcctccacagcgagaagctccagcggcacgtccgcttcctctactccaagggcagcctgtataagatcttcaacggcaacctgctcttccacggctgcatccccatggcggccgacggctccctcctctccttcccggtgaacggggggcgtctctccggcaaggcctttctggactatgcggatttggccgcccgccgggcctactactccgcccccggctcggcggagcgggccgccggcatggacttcctgtggttcctgtgggcgggccgcaacagccccatcttcggccgcgaccgcatgaccacctttgagcggcgttttctcgccgacgagtccacctggaccgagcccaaaaacgtctactaccagctctacaacgacccggagatctgcgaggcgctgctgcgggagttcggcctggagggcccccactgccacatcatcaacggccacgtccccgtcaagtccaagaaaggggagagccccatgaaggggggcggcaggctgctggtcatcgacggcggcttctgcaaggcctatcagcagaccaccggcatcgcgggctataccctcatctacaactccgcctgctaccgcctggtgtcccacgagcccttcgtgggccgggcggaggccatccgcaccagccaggacatcgcctccacctccgtggtgttcgagcggctggagtcccggctgaaaatcgccggcaccgacgtgggccgccagctccaggagcagatcgacgatctgatggccctcctgctggcctaccgcagcggcgccattgccgaggatcacaaggagtattgacgagggcccccgccctctggtacactggaagaaaaacggcggtttccgccgaaaggaggctctgtatggccctcatcgcttgcccggagtgcggaaaagagatctccaaccaggcccccgcctgcatccactgcggctgtcccctcgctccaagggctcccctcgatccaaaccgcttctccgtggtgctcaccgcctgccccgaggactccgaggggcgttaccacgtccgaaagctcgccatccacctggaggagagcgtctgggaagccatctacgcgtttctctcccagcccgcggccgaacgcgccccctccaccctccagacccatctgacccaaaaggacgcctgggcgctggccgacaccctccgcggggcgggggccgaggtgcaggtgctcgactccaccatacccgacgtcccccagccccatcccttcgaggggtgccgcgccatggacttcggcaaaaccgtggccgcagtgatccttggcgtcctggccgcgcagttgatcctcctccccctggccttgctcctctcctagcccaccactccgccccttccggcgaaaaggaggttctccccatggcgctcatttcctgtcccgagtgcggaaaacagatctccgaccaggcccccgcctgcatccactgcggctaccctctgcccaagcagcccacagccccggccgctcccccttccccggaccgcttctccgtggtgctcaccgcctgcccggacgggccggagacccagagcaaggtggtggagctgctcatggccgagctgggtatctcccgcgccgaggccgaggcctacgtggataactgcacggtggttccctctatcgtcctgcgggaggggatgacacaggacgcggcccaggcgctgacattcgccctgcgtggcgtgggggcttatgcccgggtggtagatcccacacagttggagccctcctctccccctccgccgcccgccgaggacccgcccgccgacgaggggaggggcggcatgggtttcggcgggacggtggccgcggtgatcgtgggcgtgatcgcggcgcttctcctcctctccctgttctaaagcgccagttcaccctctccgcgggggtgatcggggccgccgtcctgctctacgcctgcaacaagctgtggtttctccccgccgcctccggcccgctccgcctcttcctggcctggtatttcagcgaccttttggccggggccctgctgctggccctggtggagcttcttctcgctctggggcgggtgtcccccatacgctctgttccggccgccgccgggtatctgctggcctgcggcctctttctggagctggcccccctgctgtataagccctcctccgtgtgcgacccgtgggatctgctggcctatctggcaggcggcctgctggcgctccccctggagcggcggctactcagccatagcatataaaaccggctgctttccaaggaaagcagccggaattttttaatcctttccagtggggacgccgcacaggtgggtcggcgcggcatcgtgggcccggtcggtggcgttgtaggaccagaagcgccagccgccggacaggttggaacactggaagccatgctgggacaggatgcggcaggccagatagctccgcaggccgctgtagcagttgacataaatcttcttccctttgtccagttcacccagccgcccccgcagctcgtccagggggatgtgaagcgcgtcggagcggagcagtccctgcttcctgacctcgcccggcgtgcgcacatccagcaggatcaccgagccgtccgccggcagctccgccaccgcgtcccagtggtgctgctccaccagccccgcccggacattctcaatcacatagccagccatattcaccggatccttggccgagccgtaggggggcgcgtaggccagatccagctcggtgagctgttcggcggtgaggcccgctcgaatggcggcggccagcacgtccatgcgcttgtccaccccatcgaaccccacaatctgcgccccaagaatgcggccggaggcgggatcgaagagggtcttgaccgtcatgttgcgggcgccggggtagtaggaggcgtgggaggcggagtaggtcaccaccttgtcataggccacgcccgcggcccgcgcctgtttttcgttcagccccgtagaggccgccgtcaggtcaaagagcttgagcaccgaggtgcccagcgccccggtgtaggcgctccgccgcccgcagatgtggtcggcggcaatgcgcccctgcttgttggccgggccggccagcgcaatgtggcttttggctccggtgacaaaatgccgcacctccaccgcgtcacccacggcgtagacgtccggggcgctggtgcgcatctgcccgtccaccgagatcgcccccttgacgcccagggccaggcccgcccggcgggccagctccgtgtcgggggccacgccgatgcccagcagcaccaggtcggccgggaaccgctccccgccctccagctctacagccagcccgtccccctggggagagaagccggacacccgtgcgcccaggcgcagctccactccctggccccggagataggcgtggatctccgccgccatgtcggcgtccaggggcggcagcacctgcgcgccccgctggagcagggtggtgtgcacccccgcgtgcaccaggttctccgccatctccaggccgatgaagccgccgcccaccaccacggcccgccggacggggtgctcgtccaggtaggcccggatgcgcagggtgtcctccaccgtgcgcagggtgaacacacgggggtcgtcctcgccgggcaggttgggccgcccgggccgcgccccgggcgagaggagcagcttgtcatagtggagggcgtaggtgctcccatcctccaggcggcggacggtgacggtatgctgctccgggtgaagctccaccgcctcctgccccacccgcacgtcaattccgaagcggtttcggaagccctccggggtctgcagggtcagctcctcccggtcggtgatcacaccgcccacatagtagggcaggccgcagttggcgtaggacacgtagcccgtgcgctccaggatgatgatctccgcgcgctcgtccaggcggcgcagacgggccgccgcagtggcccctccggccacaccgccgatgatgacaaccttcatgcttcttccctccctatgcttccagcggcccgcggtagcccagcaggccccccagatcggtgacggaataccccgcccgcgccagccgggctttggcctgggcgctccgcgccccgctgcggcagtagacaaacagtgggctcccggcaggctcggcgatggtatccagccggtccaggggcaggtttttcgctccgggcaggtggccgtcccggtattcctccggggtgcggacgtccagcaggacggcgcccgaggtgttgcggtattgttccaggccctcgctcagcgcggggcggcgggcaaagaggtcaaacagtcccatacattcagcactcctttttctcacggacgggcgggccgtcctggacgctctgtctgtactcaggataccagaaacagcccgccccttccgtgacaaaatcaccgtaggctgtccgatgccagagcctccagcgccgggagatccagcagctccaccccgccccggcccagccgcaccagaccgtcgttctggaagtccttgagcaggcggctcaccacctcccgggcggaacccaggtggcgggccagttggtcatgggtgaggcggagggaggcgctctccgccaggcggctctcctccaccagcagggcagccaggcggccgtccagcttcttgctcagaatctggtccattcgccacatcacctcggagaagcggtcggccatcagctcgctggtgtagttggccactgccgtgctctcctccatcagcccttgatacacctccgccggcagaaaaagggccgtggtatcccgctccgcctccaccagcacgtcgaactggatgccccgcagtacgcaggaggcggaaaaaaggcacatatcccggggaaagagccggtagagggtcagctcccgcccctcgtcggtgagcatataggcgcggagctgtccctcggtgggcaggataagccccgcgcactccgtcccgccgccgtacaccatctccccccgggcaaagcgccgcaccgcggcgccctcctccagccgccgttgctgtccctccgtcagacgagcccaaaagggcaggtactcccgcagcatcagccttcctcctctccctcgttggcctcctgggcggtgcaggcctcggccggaggcgcctcctggaagtgcacctccagcaccgcctggggcctgttcagccggatggcggcgtgccgccccttccgggccgccgcctcctccagcagggcggccagctcccccagcacctcccccgtcagggggccgccccgccagtggaacaccaggggcttccccttgcggacggcctgggcggcccgcccggccacctcctccggccgggtgaaggagagcttggcctcccggtagtagaaccggcccccgtcggcgcaggccggcaccggatagaccagggcctcgtgatcccggaacagccgccggtcgtccagattgaagtagtcgtagcgcaccagctccgccgatcccagcgagttgtcaaaggtggcgtccaggtggtaatacgcatcccccaggcgcaccacattccaggcatggcggtacttgatccccttgtccgggttgttctccgccagggccacaatgcaccacacccccagccggtcacacaggcacttgaccgccttggcaatgccctcgcacacccccaccccctggcccagcgggccgagaatctcgtgggagtaaggctttttcagcttgtcgtagcggacattccggcagataaaatcgtggacataccgctccttctccccctcgttcagccccatggccgggcggcacaggcggtccagccgggcggccagcgctttctggtgggtctggatctttcccttgtcgaagcggtactggggcagcagctccaccgtggcggcggccgggtgcacccggtaggagaagccggtgacgtagaacagctccgggcagtccagccgcaggcgggccagcacgtcccccagctcccgcccctccagccggggtaccgggaaggcggggcggagggcggccagcccggtcttcatggcgtggtaggccgcctggccggccttgtccagctgccggaaatagtacgacccggtcatgcctcctcctccagcagccggagcagcgtccgggccacgccgtcctcctggttggtgcccgtcaccagccgcgccgccgccttggcctccggcgcggcgttccccatggccacccccagccccgccgccgccagcatggagcagtcgttgcgctcgtccccgaaggccaccgcccgctccagggggatgcccagatgcgcgcacagggcggccatggccgcccccttggtggcgtcccggtgggtgagctccacgttgccgggcagggagcaggccaccgagagctcgggaaactcctccgccagggccgcgagcaccgcccgctgggtggcctcgtcccgaaagtagctctggatcttctgcaccggccgcccccggcggcccacatagccccgcagatcctccatggggcggcgcatctcccggatgatccgccgggagaccgggtccaggatccagtcgtccagcgcggcgtagtacctggcctccatccagccgcagttgtcctccatatagcagtccagggtgccgggaaagtcctccagccgggccatcacccggacggccagctccggggacagctccgcccggcggatggccctcccctccgcccggtcccacaccaccgccccgttcatcacaatggcgtaccgccagaagggcagctcctgcaccgcccggggaatagcgttgaaaaaacgcccggtggccggcacgaaggaaatcccccgctccgccgcccgggccagggcctccgccgtcccgggggacagtcccttgtctcccagcagcagggtgccgtccaaatcgctgaagatgatatcaatgcgcaccgcagatgcctcctgaccgccccgtggctccttccggggcttcgctgtctgttttgtctattataccgtgtcccgccccggaattccaccccggtctgtccgatttgacaaaacgccaaatatagtattgcgcttttccagttagccctatataatgtagcggacgaatgaattgtaaggagtggcagcaccagtgaaaatcatgaagcgcaacggcagcgaggccgcctttgaccgggagaagatcgccgccgccgtcaccaaagccaatctggccaccgaccagccgccggagctgtccggcgggcaggtggcccagctcgccctcagcgtggagcaggccgccgcccggatgggccgcaccctgtccgtggaggagattcaggagctggtggagaccgagatcatgcgcctgggcgcctttgagaccgccaagcgctacatccgctaccgctatgtccgctccctggcccgggcggccaacaccaccgacagccagatcctcaccctcatcgagtgcaacaacgaggaggccaagcaggagaacgccaacaagaacccggtggtcaactcggttcagcgggactacatggccggcgaggtgtccaaggacatcacccagcggctgctgctcccccccgacatcgtggaggcccacaaggcgggcatcatccacttccacgacatggactactacgcccagcacatgcacaactgcgatctggtcaacctggaggacatgctccaaaacggcaccgtcatctcgggcaccctcatcgaaaagccccacagcttttccaccgcctgcaacatcgccacccagatcatcgcccaggtggcctccaaccagtacggcggtcagtccatctccctggcccacctggcccccttcgtccaggtctcccgggagaagatccgcgggcaggtgctggcggagatcgccgccgtgggcggcaccccctcggaggaggtgctctccggcatcgtggagaagcgcctgcgggaggagatccgccggggggtgcagaccatccagtaccaggtggtcaccctcatgaccaccaacggacaggcccccttcgtcaccgtgttcatgtacctgggcgaggtggacgatccccagaccaagcgggatctggccctcatcatcgaggagaccctggtgcagcgctatgagggcgtaaagaacgaggagggggtttggatcaccccggccttccccaagctcatctacgtgctggaggaggacaacgtgcgccccggcaccccctactactatctgaccaggctggccgccaagtgcaccgcccgccgcctggtgcccgactacatctccgagaagatcatgaagcagaacaaggtggatcagaacggggagggccagtgctacacctgcatgggctgccgctccttcctcaccccctacgtggatccggagaccggaaagcccaagtactacggccggttcaaccagggcgtggtgaccatcaatctggtggatgtggccctctcctccggcggcgaccgcgagaagttctggaaggtgttcgacgagcggctggagctgtgctaccgggcgctgatgtgccgccacgagcggctgaagggcaccctgtccgacgcggcccccatcctgtggcagtacggcgctctggcccggctgaagaagggggagcccatcgaccggctgctctacaacggctactccaccatctccctgggctacgcggggctgtacgagtgcgtcaagtacatgaccggccgctcccacaccgatccggaggccacccccttcgccctggaggtcatggagcacatgaaccgggccaccgccgcctggaaggccaaggagcacatcgacttctccctctacggcacgccgctggagtccaccacctacaagttcgccaagtgcctgcaaaagcgcttcggcgtcatccccggcatcaccgacaagtcctacatcaccaacagctaccacgtccacgtcaccgaggagatcgacgccttctccaagctgtccttcgaggcccagttccaggccctctcccccggcggcgccatcagctatgtggaggtgcccgacatgcagcagaacctggaggccgtgctccaggtcatgggcttcatctacgaccacatcatgtacgccgagctgaacaccaagagcgactactgccaggtgtgcggctttgacggggagatccggatcgtggaggacgacggcaagctggtgtgggagtgccccaagtgcggcaaccgtgagcagagcaagctcaacgtggcccggcgcacctgcggttacatcggcacccagttctggaaccagggccgcacccaggagatcaaggagcgggtgctccacctgtaaggagggcggttccagtgtactacggcagcatcaagccctgcgacatcgccaacggcaccggggtgcgggtgaccctctttgtctcgggctgcacccaccgctgcaagggctgcttccagccccagacctgggacttccgctacggccagccctttaccgccgagaccgaggaggcgcttctggaggccctggaccggccctacatcagcgggcttaccctgctggggggcgagcccttcgagccggacaaccagcgcgccctgctccccttcctccaccgcctgcggcagcagctcccggacaagaccgtgtgggccttttccggctacacctgggaggagctgaccgggcagagccgcgcccgctgcgaggccaccggcgcgctgctctccctggtggacgtgctggtggatggggaatttgtggaggctctcagggacatctccctgcgctttcgcggctcctccaaccagcggctgctggacgtccccgcctccctggccgccgggcggcccatcccttgggaaggctaaacaacaaaaaacaggccggccggagcgggacccctcgctccggccggcctgttttttctccacagcgtcctacatcccgcctccgtagtaacgccgggccagctccacaatggcatttaagcacttgtcatcccgctgccgccagagcagatgctcctcgctgggcgggatatctctcagggggacgaagaccacgtgctctccggcactgaagcgatagagctcagacaaaacagcaatcccgcatccgcaggccaccatggtgaagatttggggaatggagtccgcctcctggaccacgtggggtgagaagccattccggccggcataagttaccaccgtgtcaaactccacaccggagattttgtagtctgggaccagaaacgcctcatgccgcagttgagagaagctcagctctcccgccccagccagggggtggccgccgggcagcacggcgcagatctggctgacggacaggctctgccgccccacgttgtccgcccggggccggccaaaagccaggacgaagtctgccatgtggtcatccagggcgcggagaaggccgttttcgctgtaaaagcgcagctccagccggaggttggggtattcctcctcgatatgccgccgcaggccggcaaaggtatcgcagacccggtcccggggcaggccgaagcggaccaggcccgagatgtcgcccgccgccgtccgggcattgttcacccccttacgatatacctccagcatctcctcacacgcccgtgcgaactcctcccccgccgctgtcagtgccactgtccgtgtgctgcgctccaccagcctgaggttcagttcgctctccagcgccgcgatgcttttgctcagggctggctgggtgatgtatagctgcttcgccgcctgagtgtagcttccggactggcagagcgcatagaaatgggacatctgcgcgatagtcatacagccacctcctcgtggtatggccattatataacatttccttataaataaaaaggaaaaacatgaatttaacaaataagccgacccgtgttatagttgccatggagagaggtgtgcggtgaaaccgcaccaaagacagaaggaggaagaacgatgaaacagacaaacgcatcccccaagcacagctcgtgggtctactacctggggacgctggccatgctggcgagcatgctcctgctcccccatctgatcccgtcctgggctgacgggatcacccccgccggcgtgtccatcgcctgcgtatttgtgggtgccattatcggcatcctgaccaccaacgacctgatcctgtgcgccctgttcgccatgggcggcctggtaatcaacggcattcagacccctgcccaggtaatcagctcctttatgggcgcctcctatgtgtggcagatcgtggtgctctatgccctgtgctacgtcatcatccgggacaacaccggcgaggtcatcgcccggttcctcctgacccgcagattcactcaaaaatacccgatggtcatggtgatgatgctcctcttcgcctttggcctggccgccgccttcatgggggtgttcggcgccctcatcgtgggtttcaccctgctggatggaatctacgccgaggccggtatcgagcccaaaagcaagctagcccgcctgctatgcctgggcgcctttatcaccatgtgtatcggccctatgaccatcggcagcatggcggcccttaatctggcggcagggcagttctttctggccgctgctggggtgcaggtagtcaccttccgcttcgtggcggaggcctttgccattctcattgccttctgcgccgtcttcgctctggccctgcgcttcctcttccggtgcgacatccgagccctgggccgggtagatctggcccaggccctggcggacaagcccctgcgcctgacccggaggcagtggatccccctggccgcctttctgatcatcgccctccactccttcaccagcccctactggcctgagatgccggtgctgagcgccctaaaggaaatggacaccgttctttttacctcagtggccctggcggtgctggcccttatccgggtggacggggaacagatcttctgccctgtggaggccttcaccaagggagtgagctggcccattgtcatggccgttgcctccatggcagctatcggcggcctgctggtggccgacgagtacggcatcaaagcctggctgacgcaggccctgggtggcctcttctccaaccacagccccctgctctttgtggccatgacggtacttattaccttggtgctcaccaacttcttctctaacacagccaccctgctggtggtctcctccctggtatccgccctgagcggtcccctggtggaggcagggtatgacatcaccatcctggccgtggccatctcgctgagctccatggtggcctacctcacctacgcatccagcggtcaggccgccatcctgctcagtcagaaaaacatggacaacaaattcatctggacctacggtatcgcggctatgctgctctatgcggcggtggttattctggtgtccgcggtgtgcctcttcttttgaaaggagtgtttcgccatgaattatccctctttggtgtccctgagggaggttgcccccagggacggctggcagaaattcaagaccgtccttccaaccgaggttaagcgggagcttatctgtagtatgatcgactacggcgcccgtgagctggagatcggcgtcttcagctcagatcccgtacgtggccgacagtacctggatctggagccgctctgtcaggcggtgctcccctatgccgcagagaggggagtcaaggtgactgccctggtggagagcgtagaggccgcccaacgggccagggcgctgggtatccgccacgtggacttctttctctccgtcagcgacgccttcggccagggcttcggctccacgccggacagggccttcgccaccctggaggccatcgccaacctcccggacctccaggtacaggcggccctgggcgcggtcttcggctgccccttcggtgacgccactcccctggagaaaaccctggcttacgcccagcgggccatggagctgggggcctcctccctgggactgggagactctgccggaaaggccgatccaatccacaccgagcgcatcctgcggggaattctggagcgcttccggccagagcagatctcactgcacatccacaacactgagggatttggtcttgccaactgtgtgaaagccatggagttgggctttacccggtttgacgtatccctggcgggcatgggcggctgccccgtgattcccaatgccaaggggaacattcccaccgaagatttcgtcaatctactccacaaaatggatatcggctgcggcattgatctggatcgctgcaccgtggcctctttggacatgagccgccggatcggcgcaccggtcatcagcagtatggcgggcaacacccttctgaaacaggatgcctccccgctacctgttaaatgaacggctacctatgcctaaaaaagcgcccgcctgcgcatagcagttgggcgctttttccatgtgcatctcggaatgtataggctggaaccttcgtttactgtccttccttcttctcccgttccgccatctcgccagcaatcttctggaaactgtcggcaataaatccatagttctcccggcggtggggtaccaggcacttgctgcagtccttgacgccgctttccaaataggtgaagtttcccccgcacttccgccccagcatataaagcgggcagtagcagaacaggcagttgaactccgtcccctccggcaccgggtggcaggggtaatattcgcactccttgttggtatagaaagcgaagtgcttgccctcccagtattttttttgttcgcccataaccgtatctccttcccgttgcgtcaattctcttttgtctcccaaggggtaaacagacagtaggcggggcacagctcccccatatagatccacacgttctcccccatctccaccggctccgggaaggtcaggttggggatgaacagcttcaaagtggtacgtttcttccctttcagatttaccccctccgccgtggggtgggtccggaattcctctacctgctgtgccaggtcggcgatgccgagctcccgcgccaaccggggcagcacctcgttctccttacagtaggatacgtggtcggggttcttgatccaggtgagattcagcatagcggtctccttcctttctgctcgtcgtcactgtctcctgcataaaactgcggccgcggcagatcccatgatccgccgcggccgcttttccgcgcgctttcccggcgcacaccgacgtgcgccccacgctcaaacaccataggtcttccggctcgtgcctttccagagcgatctcgctcctgcgtctgccgttccgccttctcagggccctgccccaatgaccggctcacgcctcgaacggcaacctcaagcacatacggctacgggtatagctccggactcccaccggcttccctcatccctgcgcctgcccgaagggcagcactcgcgcagagtcatgatgctccatataaacttggctgtgcacccttattatactccatgcaggccaaaagtcaagagacgggtggcggtcctgctgcctcggcattcagaaattgtgttttgatgatattcagacccaaccggccgccggccgccttgccgaacccgtcgataatctgattgattgtatccgcactctaaaagatttttaatttttcctttgcacgggtgatggctgtatagaaaatgccgtgggagatctgctcggaattgctgctggggatgacctccttggcggaattgtactcgaggccctgcgccttgtgaatggagactgtataggccaactgaaaggggacgaccgaaagcccaaggagtggtcgtcggagatcccgtccagctacagacgaagtcatccccagactcttccgtgtttttgatctcgtccccgccggtaaagcggatcaccgcggagtccttgctaaaatcgagcgacgcgagaaacctgggggaaatgtacttccagaatacgcgctcctgccctcgcttccccgtatttaacaccaggaacaagataccggggtccagcgtaacctccaaagccacatatgcagggaaggcaagatcccgtagccgatagtggacagcgccgtccagcgatatctgcggggtcgaggttcccttactctggaccacaaagctccgctttggccgcctagacacctctggagacgggactaattcaaacgtcccatccgtattaggccatgtgtcttcagtcgagaacctctcactgattttccgcccgagcccaaaaatgcctggagcattgtaacagcgtcccggtcatcaccagaccatgcggtgtgggtgttactatatcgctgaagctgttcagatataattttcatgcccccttcatgttgacagaaaatccttccaaaattgcttatatgctaattgtaatcaattttcgctctttattacaagctacagccatatcctctgattccaaaattatatcttttcctttcgcctgcaaaatccagataatattttgtagtaaaacaccactatagcatgactgattgccagcatatcatagaggtattccaaatttaaaaaccacgtctcagcctcaattggctaagacgtggctttcaaatttggaacagacggttaaaaccgacaagaaaaaagccgcacacagggcggccccaaaccgaagcccagcgtaagctggttctgtttggaaaggaggagcagcggcgtgagcgcgctctgacatataaaataagtcggagcaagcgatccatagcttgctccgacatggtgcgcgaggcgggacttgaacccgcacgtgcgtaatgcacactagaacctgaatctagcgagtctgccaattccaccactcgcgcatctttagcgctctttgcagcgcgaagattatattaccatctgtccccccacttgtcaactccttttttcgatctttttgctttttctggtgcggagaggaaaattccagttgacaaatccgtaacggctcgttataataatctagcagtctttcgagacgacaatatgcggatgtgctggaactggtagactggctagcttgaggtgctagtggcccatggccgtacgggttcgagtcccgtcatccgcaccatactgaatgaccctacctcctctgaacaaatgactgacattgttcagaggaggtagggtcatttcattccagaactccttagactgcaagaggtttgacctttttatgcgaaacattttgtgtcaccaatcaaatacaaacagcgtaaaattaaagtgtaaaacgtgtatacgacgagattcgaactcttaaagtgtcatcgagatgtgttgctcatgaatacatcttccacccgacatggcgtacagttttgcaatgtgcgataagattcactgtgtattataaacctcgatgcaggaggccaagccgcgcttgaaatccacttctgaggggtaatgctgtctcgactggggaagaaacaggtactcataaatattggttttaaccgtctcttccaagatatataagcaaaaacactgagaagtgcggtgtttctgctatttcggatagtttcagaagaagtcaacacaaaaagtatggtttgggaagatacgaaatccagttttggagggacagagcgtttcaaccctctcctcatttgaccaaggcacacaaaatcaagcggcctgttgatttcacgatacccggaggtaacaggcggctttttcattccctgtagttctgtcctttatagtgcttttgcttcatctgttcaccattccttggcggtggataaggtaaaataagtttcgcagaaaagatgagccaaatgcacacattgaaaaagggatcagatgagacaagggttgcaggcctctcgtagaatgaaattgcgacacagcatcccaaaagaagtctgtaaaccatgttccaaaaattttacaactaaatgaggcagtaattaagagtcctacaaggaattggtgcgaggtagcgtggaggtttcccctcaacgagttattggaagtcgaaggcggagaagctctcggtacgagcgcaatgaacagcgctaaggctaccgcagcggccactgtagccgtagcctcattaccacttccggtgaagtcgccctcaaggtgcccaagctcaaggggatttcctttaaaacggttgccattgtgagctgtcgctgccgggagagcagtgtgaagaaaccctgatcgagatgtatctagccggcgtatccatccggcgtgtgtaggatataactgagaccacgtgggttctccggctactatcagcaaactaatgcggtcattctgacagcgattgcggtcaataaggatggacgctgtatggtcatttttaccgtaaggtatattctgtcgttctcgatccaaggtgaagccggaggttatcatgaggttccgctcataatataacacctgcttttatctggctttccagccattctttgtccggcagcaaaattcgttttatctcctttgtactggattctcttgtgcccggcagagccgttacatgctattaaaatgctcaatcatgtcatcaaagctctaccacatccatcactgcctgctccacatacagaggcgctttggcgtcaagcatcagggacagcttcacgctgtatccattgtttatacaggggtgcattacagagacatagtgcaatgtctgctggccgtgtgccgggtgtcctatggaaaaatgcagaggcagcgcatctgtaaacgcaccacagggcgactgtctgaggagaattgtcccctcttccggtgatgtagcgcagacattcagtgcgtattggactgcgtaggttttccctggatcaagctgaatctgagcaggggtacgttcgtccaaacagatatcttttcctgaacggcttcgctgtctccagcacaggcgacagtccggattccacagcattctctcccgcagtcctattaattgaacagcgcttttttcacaggacagtacctgatgagacactagatggggtggggagcaggacaccggacactgggacacacagggatctggccggcaaggggaaggacagggcgtaggtcccggctccggcttacaagctggcggcgggggcgatggaagcgggcaaaactctagcacctgagccagcttgtttttcaacagcatctggttttgcgtcactgcctcaacaagggcggtgacgcttttgttgacggccagcacgtcatggggacaggcacaggggcttgtgccgggcagagtccccaggatatattgtagtttctcaccctcagcgttgagaatatgactcagggcaagctcttccatggcaatggacgcgataatcatggtcagagcttcctcttgggtcatatccgccccgttgggtggaaaggagggcatagacatattaaaactccatagttcgtcccggcggggccgggtccaagatgtgcggcagggtatccatgccgccgtcttaccctatgacatccggggcagttttgttccaccgggaacctgttggctggaagatacatagaatgtcccagcgcgacgttttggagtgcctcgctcccgccagcgcaccggtgcatattagtatgtacctctcaatttgaaaggagattcccgataatgtctctgcctagctttcccgtagtgaatccccccattgaacgggaagacgcagttaatcaaattctctcttctattgcgatggaagaactcggcctgagccatattctcaacgctgaaggagagaaactgcaatatattctgggaaccctgcccggtctcagcggccctcccgccacagtcagcgacgtgctggccgccaatgagagcgtccgcagtatgctggaaaccgcggcgcagaaccagctctttctgaaagcaaagatgcagggcgctttgacagcctcccccatgcagggtccaaccggcgccaccggtcccacgggggcgtccggtcccactggagccacaggtcccaaccttacctccaccgccgactttgccgccaacacccagggcagcagcgttctggtggcgctggggggcagcccaatccccctgcccaacgcccaagttctgtcccccgacatcacggccaacaccgggaacacggtgtttaccgtggccacggcgggcacctatcagatatcttaccatgtgaataccactgtggccctgctgatgggaacccggctggtgatcaacggggtgaacagcatcccctctaccatcaacccggtggtctcaacctctaactttgaaaaccagattaaggtcaccctgcccgcaaactccaccattacgttgcagctctttaccacaattgccggaaccgccattctggtaagcggcggcgcgggggcctctctgaccatcatccgtctgagctgagtgccgccggtaaaaaccggcggaaacaatatcatgatgaatcaaaaggaagcgccactatgataagcgtcagtctgtgtatgattgtaaagaatgaggaagatgtgctggagcgctgtctgaagagtgtggctggcctcgtggacgagattatcattgtggacaccggctccaccgatcggacccgggagattgccacccactttaccaatcaaatctttgactttccctggcaggatgacttttccgccgcccggaacgaagccttttcccatgcgtctatggactactgcatgtggctggatgccgacgacgtatttttggaggaggatcagaaggcttttctcaacctaaaagagactctggacccaactgtctcggtggtcatggccccctaccacaccggctttgacgaacgcggccgcgtgaccttctcttactaccgggaaaggctgattaaaaaccgggctgggatgtgctgggtaggagccgtccacgaggttgtcacgccggttgggaatgtcctgtactcggatttcgccgtcacccaccgcaagacccgcccctccgacccagaccggaacctgcgtatctaccaggcccaactggctgctgggaaacagctggaaccccgtcagcagttctactacggccgtgagctctactaccaccatcgctgggaggaggcgttggatgtctttgagcgatttttggaagaaggccagggctgggtggagaacaacattgacgcatgctgccactgcgcttactgtcacaaggagttgggccatgagcaagcggcgctggctgcgttatttcgcagcttcacctacgaccgacccagggcagaggtctgctgtgagatcggaaactgcttcctccggcaggagcggtaccagcaggctgcctactggtacgctctggctctgacctgcgcccgggatgatcgcaggggcggctttgtctctccggactgctatggttatctcccctgtatccagctgtgcgtctgttacagccatctgggcgaccagaaaagagcggaaaccttcaatgaactggccgccgcctgtaaaccggattcatcggcggttcttcacggtcaggtagaataagtttcgcaaaaagacaaagagacatggtttgcagatgtctggtagaatgaagttgcgacaccaccattcgaaaggagacagcaaaccatgtccgaaaagattgtacagctaaacgaagaagttatcaaggggcagctcaaggaacttgtgcgcggaagcgtagaggaaaccctcaacgagctgctggaggccgaagcggagaagctgacccaggcggcccggtacgagcgcaatgagcaacgccagggctaccgcagcggccactacaaccgcaaccttaccaccacttctggggatgtcacactcaagatgcccaagctcaaggggatctcctttgagactgccatcattgagcggtatcgccgccgggagagtagcgtggaagaggctctcattgagatgtacctggctggcgtatccgtccggcgtgtagaggatattaccgagactctctggggcagtaaggtctctccctccaccatcagtgagctgaacaagaaagcgtatgtccacatcgaggattggcgtaaccgtcctctgcaaggcgggcggtatccgtatgtctatgtggatgggatctatctgcgccgcaactggggtggagagtttgaaaatgtggccatcctggtggcaatcgcggtcaatgaggacggatatcgtgaggttttaggtgccgccgagggcatgaaagaggacaaggccagttggatcaacttcttccagtggctgcgtggccgtggcctggacggcgtgaaactcatcgttggagataagtgccttggtatgctggaggccgtgggcgaagtgttccctgaagccaaataccaacgctgcaccgtccacttttaccgtaatgtgttctctgtcacacctcgctccaaggtgaaactggtagccaaaatgctcaaggcgatccacgcccaggagagcaaaaaagccgctcgtgaaaaggccagggccgtagtggaggagctgtgttccatgaagctgaaagaggctgctaagaaggtggaggacagcatcgaggagactctgacctattgtgattttcccagtgagcattggacccgtatccgcaccaacaatgtcattgagaggctgaaccgggagatccgccgccgtactcgtgtagtgggcagcttcccggacggcaactctgcccttatgctggtctgtgcccggctacgccatgtagctggctcccagtggggcaacaaaaagtacatgaatatgaagcacctggaggccgccattgaggatgcctccattgccggctgactccattcatgccagagcttgcaaactaaagtgcgaaaaaatcttgacacgaccaataggggaacgttgataaacgtaatttccccacagaataccacgcttgttacagaatacacgggaattttgtaaaattccgtataattcgacgcacgaaagccccgcaaagatcaggatgacctttgcggggcttatacttcgacaagatatgtacttattcccggctattttaaacttctcatattcatccccgtttctttacaacgaaacgagcattagaggtgttatccggtatttttcaatatgacgtttgactaattgcctccacctctatctcccaattatgttactctacattcaaaattgcaactttggcaagagccgactaggacgtattagaaaagcaaacggacagccatttggagtgtctatcaatgcttcttgctcacaaaaactacttcacttcttgatccagtccttgaaacaactccgaactgaaaaattcttctattgagattccaaggccatcacataacttttttatcgttgtaactgtggcgctgtgattgcgcccactgacaatgttattcaccgtggactgcgtgacaccgctcaaaaggcacaacttattgatagataaattgcgctcacggcataaatctaagattcttgccctaactgcctctccaatgtccacgggtatcacctcaatcctatattgaagatacccgattgaacttgaaatgattacctcttttgagttaaaataactcaaaagaggtataccgcctattggggaacagctttgcagccacagcaccggcctaacattaccggcttcttgccatgacctccaatagcttatctaaaatttcttttgtagcccagaaatcagcgtcaggcaaatgggagaggcgatccgtaagaaattggagggcggcgctccgctccgcctcactattactgctctcaataccaaacaaaattgcatcagcaggcacggacagcaaaacacagagttgtttcagcgtagccagcgacacaccaacagcgccgcactcaatggccgaaaggtgctttacaccgaggccaatcagttccgcaaggcgttcttgcgtcagcccagcattttcccgtatttgttttacattttggccgatttcaagattgattggttttttctctttcatagtaacaccacctttttttgttagtctaactaatggtggcattgactataaccatctacttttattataatatataacaaatatgatagtgagtcttggaatgtgagcaggggaaacgccgatatgaaaatctggttcttcatcggccattataataattttgacaccatgacaaccgaagtgtagtcataaaagcaaaaacgccacctagcggtgacgttaattccccattctactatctgacaccacggggcctttcacagcacttgttggagacggcgcggaaacgctcggcccgtggcctaatatgcgtgacacccaatctgggggctataagttgaaatcaacgaccctaaaaataatgtgtcggcattacactatcttagcacacttattggggaagatcatagtttgaaaatctgatctcaatcaaacttcaaaagttgatacggggcaacatctaaagcatttgcaatacggtaaatagcaaccattgacatgggataaggtgttgaagattcaatgtggctaatggtagagtaacttaaatcactcttttcagctaactgctcctgacttaaatttgcttttttcctaaaatattggatacgaaagcctatgttcttcaaaaattgggcttcgcccattaaatattcggaacgactacccaatcatcttcactccattcatgtgtagtgtggttatgatactaaattttccatcgcacatgaacgttgcattatagtattatattgtagtattttcgcaagtatgataatatatttatgcggtttctggcaaaacaccagatgcttgaaggattatttgggcaactacatggacgcatagatcacccttacgcggaaggagtatgagagatgtctgcttatgattttatcgatactctcgcagtacaaattctcacctacaaaaaagaacataacgaaaccgctacgcagtttgctaaaggatgtggcgtcagcgccgccacaatccgtagaatagaaaacggggatgccaatgtgaaactgagtaccgctgataagctcctccgctacatgaacataactctcattgatttattgccccccttggctacagaaagtcctattgcagagggaaaagagcgaccgagaaataaagaggccactccagccccgcagggagaagtggccgaaaagaagattttattttccgagcttttagcgaatattccatcagatgaagtgctgacagagctgttacctgatccttaccgcccccaaagggcgctgaccacgcattccgggctggaggtcttaaaactgcgcctggaagggctggacacggctcaaaccgcggagcggctacacatgacactcagccaagccgatcatcggctacggaaaactgtgcgtcagcttacccggtacataccggaaaacatagtgattgatattcctgccctgcggaagatactggaaatacaaccgtttcatttcacagggcgctatacaaaactgtcggagctgttgcgggatatgccatccgatgaagtgctgtttcagcttgaccgcgagcgtgggaatttgaccggaggcagaaaaaggcatcgtgtcagcaatcaggacttgtatctcctgcaacagcggctggccggccacacctatcggagtattggagaggaacttggtatgtctcccaaagcagtccgtcaccggatattgcggatcaaagttggattaaaatggtatttagctgttgatctggatgtacccgccctatttaactaagggaagaaattggacgccttttcgccttgtgaaaagcttatctaccatagtctttccataccttagaaacacctcaaaatgaacgccggaggcaacattatggttatagataggacaacagggaagggttgcgctttaagcatagcggctaagacggtcactcgaaatctaattgccgatggcattattggcaaaacaattgctaaaaaggagcgccctaaacgctctgtttggctccgggtgcgagactacggagatgattgggtatgtattggcgggaatatcgctcatgaactaccagaggagccgttatgggtcccatctttcattgacgagaggatatggacacaggcggtcagcaaattccatattgatagcaggttagacgaaaatgtagtggagtttttgttaccagaaatggatgaatacctgcaaaatattcctgattcagaactgatttctataacaagagatttcctaatagagaacggcatactcgatcagcccattcggcggcacaaggggaacacatattatttcgacaagagtgagatttattctcttgataatgagagcaagttatttccatacgaagggagaataaaccatattttcacagtcacagggccagatgcagcatttttcaattcaggcgtttggattaaagctgcgccccggtttgaagttggaatgtcgctgaaagaatgtatcgggatttttgtagaaacagaactggcacataggaccccgcagaaactatctccccttgatcaacttatacagtacatagctcggcctgtatatgagcgcgttccaggcaacgacaatgtaaaaacatttgaccgtattcgcataactgttggtctcccccgataccagttcaattcgtgggaagctctgcaaagtgaagtgaagaaatatcagcacgaaatatatcaacgagtaatccaacggatggaaacagaccgttcgttcaagagatatggtgtaccaattaattttcttgaaatcagtgatgttacattattgcgggacttttcactagagtttatttttgagctgaaagaaccaaaaattaactaaacagggaggaatttagtgtggagcagaaaaaatcaacactgaaagagatcaaagctacagttatgccgcaaacagcagagggcctgcaaatgctgatggaggaaacaggattaaccatcggagaagtgatcgaccggctgacgctgcaaatgtgtcctgatgacttggggttcgcagtttgttttgcaaaagatcaggtttttttcagtatttcaagcttgccggaggaagaacaggaagaagccctgacgaaaatcattatatttttggccgggcttgtgccagtagatcatctaaagggcttagagcaagcagccatttccaagcgtgcagagagattaaaggaatataaggagtacatcgaggacttgccggaaaaggatacgaaaaggatattaaaagaactagctatactcgaaaaaataagggcacagaaataacaattctgaatatcaagaaagtgagtgaaatcgcatgaaaagaaccaaagagatgaaaaaagagtggatagccgagttaaagaaaatgcaaaaatcctatcagggggaaatttcccccgacgatctaccttttgaccttactgctgaacttggggaggttgtaacagtagaactaaaaagtcccggcgtatattacattgcgaccaagaaagcgggagatattccagagtgtccagaggtatatgttgtgacggctgacgctccagctatatcagagaaagcctggacttatggacaggaatttcccggccatcccgatctgcgtgtttatgacattctccagcccaaaagcggaagatatatcatagattttgaaatgcgccggtatcagataaaatgccacctgccggaaatcgaggacgaggattctctatatactgccgcactctatggagcggaagaacatccggattattttggcgctttccctgttccttcctttactccaagagggttcactgtacggcataagaccattctgaacggtgtgtattggctggaaacagatcgctgcgaggaaatgctggcggtttgttatccaatctggaagtcagatattagtattccagagcaaaaccagggtgagcaactggagtatgaccgtatgtatgggattgacaatacccttggttatctctttttctccaagcagaacagcgtcatcccactgcatgagctttcccttttttacccagaaataaaggaaagcagtgtagttgatatggatgcgctactaaacgcgatttgcgaattttacccggagtatgtcacaatccataatgaagaagaagcaaaatttgagcatggacgttttataaaggagacgcccggtgttggtacagagtttatcaagttctgataaactttatgctgagggataaaagttaaagaggatactcctttttagcggctgaacacactaagtaatcgaactaaaaactatgctacctacgcagggtagtttttagtttgatttgctatctgaacagatggcgtgatatactgattctagataatcattatgataagtgtttctaaaacctcagatggcttttggggcttccccatgtaggcagccaatccacaatagaagggatttttatgaatgaacagcaaggtgtcaggccaacagaacgaatgacatatagagatagcacctatagtattgtctcaaaggttgcctatctaatcggcgtcccaaaacgaatatttgagaaccagcatgagccaccgcaactcgaaatattccaacagttagagaatgacaagaacgcccggattattcgtcatctgtgcatcatacggacagcgattgaacgaaatttcaagtacatcaatgataaaatgagaacggaatataaaaccattctttcgctgccacaatttgtccctgctgattctatcagccaactatcagcggataacgtcaattttatcagaaagtggaacacaaaattacctgcacatattattgaaattaaccgaattatttcggaccgtatcaataactgcaagcatttatttcccctctggcttaactggaaatacatccgagagcttttcatcatgcccaatggtctatgcgaaaaagggactcaagaagcagcggcagtctattatgaacacatattgctttatccctatcaaatgtatattcattggagtcccagcgatcagggcaacatcttgttcaatgataaaagatttgtttccctgctctatcgttggcataatgacgagtttaccgagtacaacaaagtctcagacgccggcagttatataaaagacagcatctatgattttattgatgacagccgaaaagtggtaatcgtagtcgattgcgaaaattcagacccctataagttaagcgcgaccctgcggcggctgaacagcacatacactgaaaaaatcacttcgatcatcctctttgacgatattcacactgcttcagcttggagcagcttggaaaagtttacctctgtttcagtggagcatattttgattgagcgtatcaagcaaaacaagtcgttggtggacattcgtctgactgcgagggcttgccaggaatattacgaaaacaacgtggattcctttatcattgtttccagtgattctgattattggggccttatttcgtcattaccaaaggctcaattcttagtgatgattgaacacaataaatgtggaccggatatgaaagccgcactcgccaactcagggattttttactgctatttggatgacttctattccggcgattcagaagaactaaaaacgaacgctctgttgcaggaaatgcgtgattacatggagaaagccgtccagttaaatgccattgatatgttgaacgatgcgctccgctccacccgaatagaaatgacttcggctgaacgccagcagttttacgacaaatatattaagacccttcaactttcgatcaatgatgatggtaaagtttcactggtcatcaaggtaaagtaaagatttctttgcaatttcagggactcgtatgcaacagcggtttgattcttaatactacatagaaagtccagctaataaaaatcaagagaacggcagaaacaggttggtggcctatgcccgccgctggccggagtattgccgggaagtggacgatgacggctgggactgcaagacctttgagatcgacaagggccgcttctgtttccggctgaccgcgacatacaacgaggaacgctgggaggcagcgaggaagtttgcaagggaacgcaataccgccgagaggttaaaatgagtaaggtaagcgacacattgcaattttcagtggaggactaagtgtgaataattggaaggaatttgtgtttaatgaaccttatgttggaggtaagattgagcgtattaacaatgtcattttgccaaagcaatatgtaggttttatgaaaaaacataatggtgggaaaggcgatattggagaaacttggcttgaactgtaccctctggaagaattgcaggaaataaatgatgattattgtattgaggattttttacccaatcatattataataggttcaaacggaaatggagaattgtacggaattgataatagtggaaattatttcaatgttccgattatgattgataaagaagatgtaaccattttgggcgataacatagatttgcttccagacaaaataaacgatttgtggaaataacaattccattttgtcggcaaattgtaccggcacaaaatcccttgggaaccagtccagctaataaaaatcaagagaacggtagaaacaggctggtggcctatgcccgccgctggccggagtgttgccgggaagtggacgatgacggctggggctgcaaaacctttgagatcgacaagggccgcttctgcttccggctgaccgcgatatacagcgaggaacgtcggggggcggcgaggaagtttgcgaggggacacaataccgctgagaggttagtttatatataaagatgggaggtatattgctgtgacttcatatcacatggtttttaagaatggttatttcgggagtattaacaaatgcggtggacttccaacacatcttccagaaatatggccgcaaatagacggagcagacttagcctttctatttcaactttattgtgatggagaaaagttgaacataccaaacactctttgtatacaagggtatcagttgtttgaaaacggagattacaattcggacattgtagtgatccaacttccgctcgatgcaaaagaaaatatccagcaggtaggtctttcgtgcccggtttccccggactatgcaggcggagatattgaatttgaagtggtagaagaacaagacaactacgacttggacgatttaaatgttgatgacttttaccgatggacaaaaatgggagtaccatgtagcaaactgctgggctggtgtgaaaaagaaatcatcccatcgaattgtgcgtttttagggtggttagcagatgaagatccttttgtcattggcaacggatataacctgtgctttttcttaacaccagagggaaaggtcattgccagctatcgtgcgccctgttaatatccagtccagctaataaaaatcaagagaacggcagaaacagactgggagcctacgcccgccgctggccggagcattgtcaggaggtggacgatgatggctggggctgcaagacctttgagatcgacaagggccgcttctgtttccggctgaccgcgccatacaacgaggaacaccgggaagccgcgaggaagtttgcaagggaacacaataccatcgagaagttaaaataagtaaggcgggaggtttgagttatggacaaaagtgatattgacaactatgcttattttcaagaagtttggacatcacctaaacgatatgctttggtaaaaaatgagtttcgcgatggatatgctatcgttgatgtaataaataaattatttgtgcttatcgaagatgaagatataaaaagatttgtccaacaaaaacttcaagaaaatgggtgcgaaatcttccgtaatattcgcgaagcatttaatagggaatctcgctaagtgaagaaattgaaatccctttaggaactaaaaggcgcatttctatacatagcctgacggccatgtattcgtgcgctctgcgaggcgggacgggacggcggattgccagatggagcaactcgccgtttttgcgtcgctgcgctccgtccaaggggctggtctcccctgccggctcggtcggcgcttcaaggcgtttcacgccatgaggttgcaccggcgacccgcgcccccttgcgtggcttacgccgcttaccccacccgcccccaaaaaggggacacccgccctgcgtctgtcccccttccgagagccttataaccgaacactgacatcctgaccgctcaccgggaacgccccggaggacggtctttttttcatccattttcagcaggggaaggcaacaccttttacatggcccgccgcaggcaggagcaaacccacacccagcgccgccgggacagggacatggattggcgagggacttcccatttccttccgtggatggtaaaatgaaattgatttgatgggccgccccccccccgctggaacattttgctccaaaagagaacggcagaaaacaaaaattatgtagcaaacggagtagagaggatggatcaatcaatgatttgtctacccagcgacgtaaaaactgctttagaaaaaacaagttttattaaaagatatgagatgctttctaatacttttaacggagaaagaacgcccttaaatgaaaggctgcgttatattgatggtgaaattgttttggacagtcttgcacagttgggatataaagcacattttgaaagcaaggagaaatatttctggattgaggaagttcagataggaacctatacgttctccagcaacatgatcttagatggcggcctggtagatatagtctggatcgtaaaagaaaacggaaatctaatcttagggctgccaataggagaatattccagattgatgattgctccaaactacaaaataaagaagccgatttttggaacttatgaagatttagatgaaatagttgaatcagtcttcaaactatttgaggattttaagaaagcaatgactgcttcgtgaggaaaccagcgcagactatcccaacctctggacactttttccggccagcgggcggcgatgaacaggaggaagaatttctatggggatttttgataagctaaaaggtggaaaaaaggataaggtgtttgaagatgaattgatggatacgcagtctgaactgattgcgcttacattaaacatggtcggtaaagcagcagataaaatatttgcctattgttccatagaagccaagagccagatgttcaatgtgttctttgaattagacggaaaaatcaaaacattaaatgaaatggggacagtcccttcttgtgctatggaacttttaagaacaggaacacacggactggacaagattaaagaaatatgtgcgaaatacaactatcccacccccacagagattaaaatgatttatgatgtgaaaacaaaaaaatttaatgttgcttatcaatataaagagatttgttccgcaaaaactaatattagtgcaggagaagtttttatgaattggattacagccaaaaagaatgagagcacataaaaacaaaggcgcggccagcagaccgcgcctttcctatgcctgaaactgaccccccgcgaatttcccctcgcagaaccgaccgtggcgctggggcgcagtacgcagacctgtaagcgggccttgcgggagctgggacgatggactctgatcctgcgggtgcgctgggaaatcagagcgccgaacaggatttatgtcctcattccaagaaggttaaaccgttgaaaaacagaagaataagccgcccaaaacagttttacaaaagatttcaggtttgctataataaacgcaggaaattgagggttttgactaatatttcaatgtgtgggagggtttcataatgtggatagttattttagtggcagttgttgcggtgctactcattctttacattaagttctataaccgtttgcagcggctttccgtcaaggtgcaggaaggcagcgcgggcattgatgttgctttggagaaacgctacgatatgctgtcggaagaaattgaggcagtaaaaaagtatctggcgcatgagtatcagatctacacagaagtcacatctacccgcgcggggaaagaactgaacgaaagcatatttcaggaaaagaaacaactgtctgaggaagcggtcaaagcaatcagcgagacgattgccgaacagcaaaagcagatggaaacaatccggcagcagttggatcagcagcgagggcaggatcattcttttggggcggaaacaccgggtatgggggatgacgggctgatcggacatcaggtaagtctggatcggaaactcggcttgcttacttccgcccagcagggactcaccggggtcaactctgccatcaatgcactggctgagcaatacccaaccctttattcctatgcgtccatgcagcatttccagcaggatatttttgacgcagaggagcacttacaggcagcgagacggctctataactcgaatgtatccttgtataatcagagacttcacacctttccttatctccttttggcaaaacttcatggaatgaaagaggcgaagttttacgctgtggaagaaaagaaaaaagactttcaggtgcagttttaagaagaagggggaaaaaatctatgaaaatggcggaacagaatatcagcggtgtcaagttggagcggctgcggcagaacgctgtaaaaaaacataagattctgcggaagctgctcccggtgtgcctgattttgtttataggattgacactggtgaaaaaccgatttttgtttgtctccatcagtgaatacggctttggagacccagcaacccagggggccttgtggggtctgattggaggcctgatgctcagcgtgatttttgcgggtgccatttttggtttttactatatgctggtctataaaaaagcttatgacctcttttgtatcaatttcaaaaacaaatatgtgttggacaccctccgacaactgccggatttttccgaattgcgctacaatgccggaggcggcctttcttatgaggaaatgaaccgtttaaagttaatccccggaggccagtcggtcttttatcaatcgtcggatgaactgtccggcaagctggatggagttcccttccgggctgtcaatgtctgcactggcgaaaaagcttccgcaagaagttctacccccaaaattctgtttgagggacaggtcattgttttttcctattttgataatcggaagatcagtgaaggttttgtccaggtgttttctaaaaaagccttgtctaaactcagggaaaccagagtcccgctgtcaattcagacagaaaacagtgtattcaacgaaaattttgcggtgtttgcagagaacgagcagaatgctttttacatcctgaccccccaggtgatggagcagattacagcttttcaggaagctatggaaggaaatgtttatctttccttttctgaaaaatccctgtatgtaacttgcagccagcttcgcaatccttttcatatttacatcgacatccctgttgaagaacagcgtcaaaagattgctgacgatacggcgattctccgcagtgcaaaggaaattctcataagagccggacaaagcagtccgaaataagaaggcagtccctgaaaggaggagggtatcatatgggatgtacaattgtgttcgttatcctgcttgttattggaatgggcatcctctgttttctgacgggggatatgacggcttttatcgccctggctgctactttagtcatagggcttggtcttgccggtattctgtatcgcgtttatcggtcacggcagcggcggaaaaggggcaacccgctgtcacctaccctgcgctggatgaatgccgcaggttccatcctgattgcagccaactggcgcacgaatttttaccggatggcaggtttccggtacaatgacgaaccagaccggaaagccatccaagcaatgctgtgggagtattgggaaatccagggacatgaggcagctatcaaagaaatgcgcggtctgattgacatgggaatgcgcatccggtaccgacaggaaatggaagttctgtcgcgcagataccagaatatgacagaagtacagctgattgaggaagcccgcaaagccaatccgaacgcgaacgaagacagctatttgcccaaaatgctgatggcatggaggcgctatggggaaaacgccctgttgggctgggacgtgggtcgttgtgcgtatgtcacccaatgttgctatctggcgggttacatcaatatgcaggaaatgctggatttgtgcgtagatgccggaacaaaggcacagaaaatttttcagaactgggaggaaatgatggagagctatctgctgggtggtcagttttggcagcacgaggaccaaaacaatccaaaatctatgacggccaagcgctggaagctctatgaacggatgcggggcggcaagaggcctttccgcgatttgccctatcgctctgtcccattcgaccagcccctctcaaaagaggttatcaccaatgaatatggtattttgccggaataccagaaatattataattatggatagatagcctctggtacagagtaggcattgacaaaagcacttacaaatactgaggtaatgctaatttgattatttagtcattgaaaaatccctttaggaactaaagggcgcacttctatacatagcctgacggccatgtatttgtgcgctctgcgaggcggaacggcggattgcagattaaagcaacccgccgtttctgcttcgctgtgctccgtccaaggggctgcaccccttgcgcggcttgcactgcttcccgcgcccgcccccaaaaggtaaacacccgccctgcgtctgtcccccttccgaggaccttataaccgaacactgactgctcaccgggaacgccccggaggacggtcatttttttacccatttttcagccaaaggagggcaacatcttttacatggcccgccgcagacaggagcagacccacacccagcgccgggacatggatcggcgagggacttcccatttcctgccgctggtggtaaaatgaaatcagttttacgggccgctccccgctgggacaaagtacccatccagtggaaaaattgttgatttagaaccggatgtaataagaggaaaatggcagagtataacgatgctatgacctataaaagcaggtttcatttgatatgttcctgctatcgactgccagaggatggaagttttacagttggtcaagagtatgctttttcgaatactattgacgcagttgagatcgtggatgctttgggacaagttatggtatttcctgaaaaaatctttgagtcttacttctgcgactttgcagatcctgtgtatcctgtaacttctttggggcctatagataagacgatctatcatctctattttgttttggatcaagggcaccacagtttagacgcaatcaaagcgtattccaaattgttcaatgtgaactatgtgcaagcaaagggcgtattaaacgataagcgggttttgattgctacaggaagtgctcatgatatgagagaaatactgaacgaactgaagcattttcaagtgcattatgagatcagtccaccctacggctctgcggggcgctgaactgtgatattgcagatgtgatcgctttggagcaggatgaaaattccataaatgaaatagagtgataaattaacataatgggaggtgcgctattactatgaataaagattttccactaaaccgctttaattttacaaatctcatcgaacatattagaacagaaatattgataccaaatgtgattaccgatgatgaaacaggaatagaattttatggtggggatagcattccccaaaaggcattgattgacttactcaaaaatttcaacataattgacaatctggttcaacaaagcaatagcgaagaatttaaaaagcaaacacaacttgatattaagaattatcagtttgaaccgtcatgggtaaaaattactcctgacaatattacggttggatatgtaggaatttatgtaaatgctgatttcagtttaaccttttcaaacatcaatgataaatgggttttggagaaataacaacttcccatttatcatcatcgggccagccagcggacggaatatgagaaaatgacagcgcaaggcgaaacattaaataacctaaagggggaatttcaatgctaatttctaaatcagagtattctgttacggaggttgctctctccaaatacgaaacggcacatggatttacctttccgcaggagtatcgggctttcctgctgaaatacaatggcggcgaaaccccggaaaccgacttccgcctgtccggtgtgtcatccgatctggtttctttctatgagctacgggacgatggggacggactggaactccatgagattgaatttcttgtacccgcatttctgaaagatcatatgctccctatcgcttccaatgtgtttggcgataacattttcatctgtgtggagggacgggaaaacggagaaatttttttccgttaccatgacaggccaaagcgatatatcaaacttgcggatgacttccgtacttttattcagaaatgcaaaagcaaaaagctggggcgctgctatacgattgaagatcggattgcgatgagaagaagcgcagggaactttgagcccccatctgcgattgcactttctgaatggcaaaaagagattgattactttaaccgtatccaccaagagcaagtagagttttgactgctgttttgcccggccagcgggcgcatagtaaccaaacaccacctaccaaggcacggcagacaggccgcgcctttttcatacccaaaactgaatacgaaacccaacaaccggcgtttgcccttttccttgctgggacttcccatttcctaccgccagtggtaaaatgaaataaaaacgacttttatatgtgaggaacacatggatcatgggtggaggtgttttagtgattgcatttgagtttggaaatctatgctttaatagtcctgcttcagaacaaagcatcataatggttattgcttccccgtctgaattttcttcgttagataaatttatagcggcagcattaacctttttagaaacagatggagagctttacggtaagcggactgtattatataaagagcgggtcaatcttccggcttccaatgaggatataacatttataacagaaaaaataaatgaaatgaacctgcgtgtcaagatagtatttcaaccagtaaagaaagcagtaaatctcctgccgcctaatctgaattttcttcgttagataaatttataacggcagcattaacctttttagaaacagatggagagctttacggtaagcggactgtattatataaagagcgggtcaatcttccggcttccaatgaggatataacatttataacagaaaaaataaatgaaatgaacctgcgtgtcaagatagtatttcaaccagtaaagaaagcagtaaatctcctgccgcctaaatggaaccaagttacgatgtgtttggaaacggaacatgattatatcttttattcatgggtaacaacagtgtaacttcctaagaaaagctgtttgcctgggacacattgtccagccagcgaacggcaggagatcactacttgagccaggagcaaatgaatatggtaggattgcaagttgaattttattggtatcagattggagccgcaagttttttgcacgctttcttttccactgtctgttttagactggaacaaggaaattggggcagtaaattcccaagattgatgaacgacttatatcatggccgtttgaaaagtgaatatgtcaaggatgctctggtagaactgaaagaaataaaacaagagttagcaaaattccagccatctgatgtgatttgggatattgaagatttaagcgcaaggcccccgtggggggacgacatcagtcctgacattacaaacctttcgaactattttgtaacaagtgatggagaagattttcttctgatattacagcacgccttggaaaaggcatgggaatgtgggggcgatctggtgataaaatccatgtgagaatgtgaggtgtttccatgtatgccgaagcgttgaagcccatcaccgacacaatgcggaaatttcctggcgtctgggatctcccagacgccgccggagccgacaaaatcaagcgccttactatagaagtgcggacagcgttaaacctcactcttccagatgaatatataaagtttctgaaagagtgcgacggccttgaatttgatggatacatcatttatggaacagatcattttttggaaaaccaagccgattatgaggatatcgcaaagcagcacattatttttgcggagtacgacaccggctggttttgcatgaaaaaatcggatggttctttctgggaattggacaagccatctggacaagaaatgcagcaatttttatgtgccggagacatgataaggtatatcttatcttcggcagttaattgagcagatgattgatggaggtggacagaatgggcgcacgcaatttcaactcatttggaaaatcattcaaattatttcttatgattgattttctgatactcattctgtcctttatcggaacagcacagtttgcaaatgagtgttatcagctcatgtcttttgctgggtttgcggcattgtttgcatggtttttttctctcatgtattgtgctttgtccgttgttgtatttgttttgctggggattgtgctgtggcgaggaaatagcattcttgcggttattgctttctttatacagattttaatccgattgccatcatgtttctttcgcatattggatggatatgccccgcattcgttgcatgacattatagttttcgctcaagtcggaatggggattattggattggcctattacacttcccgcaggaagtgcatccccgtccctcagccgtctgccgcacaacagaaaggagctgatttttatggccagaaatgacggaatcgaccgcacctttgcccgtaaccaggacttgcccacccttgatgatgtggcaaaggtgcaggaacacaatgaacgagaaaaggacagctactccaaccaggatattgataccacccagacctaccggaatattcacttcaaagcacccaccgacagctatgccgccatgttcgatcagttgattgccgatggcgttatctctacccgtggtctgaaagccgatgcggtgaaatacggggaactgatttttgatgtgaactctgcctacttccacaaccacggtggctacgaatatgccaagcaattctacaccgatgcatacaaagctgccgtagagatcgtgggcggtgagcagtatatcctctctgccgtcatgcacgccgatgaacgcaaccgggctatgtcggaagctctggggcaggatgtgtaccactaccaccttcatgtggtctatgtcccggtggtggaaaaacagattctttggtcgaagcggtgcaaggataagtcccttgtaggtacagtcaaggagaccattatgcaggtcagccgcagtaaaaagtgggaatccaaggtagctctggatgagcagggcaatccgcttttgacctccaagggcaagaaagtcctgcggacatcatacagtgtcctgcaagacgatttcttcaactatatgaaagctgccggatatacggatgtggagcgtggagagcgtggcagcaccgaggaacatctgacggtgacccagttcaaggtagcacaggaacagcagcggctggaagatgtgaccgctcaaatcgctcagacagagcaggcgctggacaccgcacaggctgctgttgaaaaaaaacaaaaagagctgcaatccctgcaaaggcagaccaaagaacagcgcactgccgccctgaccgtacaggaaatccgctccatggggaaaaagacgatctccggcaatatcgctttgaccccatccgagtgcagcacactcaaagattatgcggtcaatgggattcttgccaaggcagaaaacagccgtttggaggaaaagctacaacaagcgaaaaagagcgccactgtctggaaacagcgatacgagtcgctgaaagaacaggcacggccttatctggaagctgtcaagctcgcacccgaaaaggtgcgggcttttcttgacgccattttgacacgaacccggcaaacaaagcagcacgatcagccttcccgccgcaagtcgcacgatatggaactttaattgatggaggaaactgcatgagaaaacacaaagattttatgaacgaacccgactatggttatatcgacattgaatcctgctttgacccgattttcgaaccgccgattgattttctggaagaatgccggaaacgctgggaaaaccggatgaatccgttcaccggtacagtggaacggaaaatcggaaatacctggtatctactggagactgtatgtgatggaaatgagccgcttacccacaaggtaaaacggctcattttctcggataaggaggcgctttgttcatgacacagactcaaattcatgctacaatatcatcatgcacaccgattctgtcagctgacccaaccgtaaaggaggacgctatgttggatcagcagaaaatcaccatcctgtactgccgcctcagcaatgaggatgcactggatggagaatcaaattcgatacagaatcaaaaagagtttttaacccggtacgcagccgagcatggctacaccaacctgaaaattttggtggatgacggatatacgggaaccaattttgaccgccctggcgtgcaggaaggctttacactggttaagcaggggcttgtcggttgctggctggtcaaagatctcagtaggtttggtcgagattacctgaccgttgggcagtacacggaaacattatggacaagagcacaaaaggcagaccgagaaacgggctgctgacaacaaataaaggctgagtatcaagcaccgggaaagtgcggaatattcagcctgttttgttgtcaggggtttccaaaggggcttgccccttggcacacgactttgctcgcaaagtgtagtgtgttatacgctttgtctgcgttgccgtgaaaacgccattgccgccggatagggcaagggcatttgaagcggcaggaaaacaggcttggatttgtgggcgggtgctgccacaaatgcggggctggtttcaacagcagatagggcgtatatgaaagtccccgtccatcgttccccgtaaaagtttggacagcttgccccgatgttgccgcttgtggtcacgatggtcagaagattgcggcggctctcgttttctcaaaatctgaatgggcgggaaagccattttagggctttcccgccttgattatcctttagcaaagtcgggcgggactgtcaacggcggcgcatgaaatgcaccgttcatcttgaccgttgactggctcgactggctttgctatttcctcgataaacttgaagttgtacttatgcacagacaatcaagcatcccgtttaatcaaagcggcatcggagtccgggcaatcacaatgactgccaaaacagcgcccgcaaacgctgctgcgccgataactgccgccgtctttttgctgaggttcttctttactgccttacagattagcatggcacaaaccacgcaaacagccgcaaccgcaagcgcaataaccagcgtctcccataaccatgaaagttcgtataatattctcattcgctcaccatacctttctctggcaaactggaagttactttttcatatacacgccttcgtcaaatcccgatttatccctttactttcgcccccgctgtgggtttggatttttcagcaagtccgatttctccgcaatctttttcagccacttcttttcgtcctctgacagcttcttcaaattcaatttaagccgtttacagataaacgccaaagacgcttgctccgggtcgccgtcctcgctggcggcttcgtctgcggcctgtaaaaatcctttcagcgggttatcctccgggacgctgaaaaaatcgtccttgtgggcttcccgcaggtcaagggctatcttgtttatatcctgctgtatcacgtagcggcaaaaactgtcctcgtcaatgtgggcggtaattagctgtcttaactgcgggtcggtcaaaccgggattgtgccgtttcataatggttgcgctcatagcgtctacaatggcattggcaccctgtatctgttttgtcgctacgccgtttacatagatttcaagttcagccatgagccgggggaaatccgagtgtgttgctaactcacacaacagggaattatccagccgtccgcttttcaatagttcaatcatatcatcactcaaacgcaggtctgcaagatcagcgtttgggtgattttttgtttcggtcaatcccagcagataatcagcggtcacgccgtaaaacttcgccagcttgataagggcatagtggctgatgtccttaaaatcgtccgcttcataactacccaaagcagatttagagagatgtgtctgctctgcaagctgctccaatgtcaggccgcactctacacgcaggtcttttaagcgttcctgtattgtcaacgccaattcgcacacccccttatgcttatttcatgctttcttgacactcgctacactctctgtcatggatagaaatgatacccccacattttgaacaagtatatttctctttctgctgttccatgaacctttccaaaccgtgctggcgaacaaactcactattcgtcatgaggctcgtctgataccttttgttgtagcttttttcaaggttttttatcagcttgcaagggtagtcggtacactcaaaacaataggacagtcctttgcccttgatacaatcttttatcttgcatttacggcagtgctccggctttcctatatcactgtttaagcaaccggcacacggttttttatgataacaatgtttatagcaaaccaaacagttcatgccgcagggggcaaacatagccgtatcaattttttctgttggcattttcatggctcaccctccttgtcagcttatcgtttctttcattctaccacaattccgagagcttggaaataggcagttttttgggcggatttcctacctttcggatatacgggatgggcggtcatttaggtgtagacttagggtagttcatcgatgagctgcaccttgaaaaccaaatgaccgtccgaaaaggaataccccggcaggggaagcaccgcaaggagccaacttctggacaatttggtgtgcaccccgtcaagtagacagcgaaataatttacattttacgcatgaaaatccttcctgcataccatatggtgctgggtgctatgcagccagtagacggtcatggacttccataggggtccgcacacccaggccgcgctggaggcggtggaagttgtaataggtgatgtactcctggatcatcttgaccaactgctcccggctggtgaaccgcctgccatagtagcgctcccgcttgaggatgccccagaagccctccatggggccgttgtcaatgcactttcccacccgggacatactctgtgtaatgccagctgcagccagcttgtcatggaagatctgagtggtataggcgctgccccggtcgctgtggagcagagggcgggctccgggattgccctccaatgcctgagccagagtgcgatggaccaaggcagcgtcgttggtgtcccggatgacaaaggaaacgatgcgccggtcacacagatccaggatggcgctcaggtagagcttgcgcatgttggtgcccgtatagtagtgaaactccgtcacatcggtgagccacttttcgttggggcggtcggcgtaaaattggcggtccaacacattctccgccagctgtcggggggatgatgccgcccgagtgcagccatgtggggcatgttttaccacagactgaatcccaaggccacggcagatgcgcagtgtccgcttatcgttgaccggcgtatggtaatacttgtccaaatcgtcccgaatgcggcggtatcccttgtctgggctctcccggtggatctcctgcaccaactgggcgatgcgctgattctcggcgacgcggcccccggctgtcccggagcgccactggtaatagctggcccgggagatatgcagtgcacggcaggctggccccacaggaaatccctcgttttccgtaccgtagcgcaccgcttcatactgctgttcctgccgaaactgcctcagcgatcccccctttccagctcttgcactttttttcgcagatacagttccattttcagcaattcattctccttcttcaaccgggcgttctcgatccgcagggcctcatcccggctccggggcgtttggtccgccaggcgcttgccacgccggtcctccaatcccgcgggacccaactcctgatactttttcacccagctccgcagcgtctgtacggctacttggtgtgcctgcgccacctcttggagcgcccggccgccctccagacaggctagcaccgcctccagccgttcctctatggtgtggtcgttcctcatgatagttcctcctctttctctcttggagtttctctcatgatacgcctttacccagtccaataccagattcccggagcgcaaatgatacttttccgcgatggccatggaactgccctgaccggacaggtactcctccgccacttggcgcttgaagtcctcgctgtacttccgtttggagcgattcccattctcctccaatgccgaaattccctccgagcgataccggctgatccaactctccatggtggtgtgccccactccggcccgacgcgccgcttcccgcatacgcagccgtcctgcaagatattcctccaccagcgagactttttcctcaaaagcaacttcttttcgtttgcccatcctgtattcactcccaatgttattttcctgtctgctttattgggagcataccactttgtccagccagtgggcgaaaataaggacataaaaatatggtgcaactttttaggaactaagggggtacttcaatacatagcctgacggccatatattgtgaaatctgggctgatttcacagcggcttaaaaaaggaactaaacggatgccctggactaactgtttccagtcagtccagggcaaaaaaatacatcaataggcgggtgtgccgtatccatagatctcagcgtgtccaatggcgtactggcgttcccggcaggcattgccggaactgccttccacggtatagacgatcccgccctccaccttttccacaatgcctacatggtccgcagctccgtcttggccttcgtcctcatcatcccaatcgaaaaagatcaggtcgccggggcgtggttcatagctgcggtcctgccacagtcctctctcccggaaccactggatgccgatggagcagcttgcgaacttggggatgacgccggtgtccagatagccgcactcattggcacaccaggaaataaagcaggcgcaccaatccacccggctctcgaagccataccaggaccaatagggccgaccgcctacattgccgagctgggagagggccaccgttacgatctccctatcacctgtgccaatgccgtatagaacagcactccacataccgttgctttcttcagccagtaactctgcaagcatctctcgctggtcagcggtaaaattgtagatgtccgccatttcatccgtggttttgtgggtcacggtaatataaagggtcgtggccgttacctcgacttcttccacaatgatattgccctttccatcatcagtttccacggtttgggtggtggttgccgtttctgtccggtggctgatctcgttcatggcccaaaatatctctttcaggagttcttttttcccatcatccatcgtagcgacttcctggggattgtccgggtcggtggtagttttcacagcatagacagccaacacttcgggccagacagcacgggagccggacagttccaggcggtcatgtgcggcgctgctctcaatttctcccagcttgccctcgtattcctggttgatctcccggacaacggtgggcatggtctggcccgtgccgctgtcctccccggaaaagaagatgccaaagggagaggcgacgatcaggccgatcaagcaaatcactacaatggcaaggatggcaacccagcctccagcggcgatagcggtcaccagcgccttaatggacgcaagcagggcctttgccgcagcggatgcgccttttgcagcggcttttgcggtggtggcggtggcctttcctgtgacgcgggcggcctgggcggtcgctctcgcggctctggctgtggcctgcgccgtctttgccgtatggtctgctgtcttgatggcggtttttgccgtgcgtggagcagtcttggcggtatgctgggcggtttttatcgtttgttgggcgcgtttgatggtgttcttcgtgcccatgcctgtgtcctttgcggcctgccccggagcctgggcgggctgttttgccgtttttacggggagttccgcctgccggggcgcttgtgtggcgtttggggtcttgatccgcgatggccggtcagacggaacagcccgatctctaatttgccgtttccgctcggcctgcttcttagcaaaggcccgacctctctctacataagagcttgtggtatctgttggatgctctatgctggcctgggcggatggatgctccgccatgcgcttatgatgcggaaggcgctggtgttctggggccgtccctctgctccgctgaccgtccggggctataccctgagccggttcagggggctgggactgttcagcggggggtgtattctcttggcgcttttctgccgcccatttctcccgctggcgttgaaacagcttccggccctgccgaaccgccgttttcgtgccggacgcggctacatttgccgcgtcgtgggcaaggtcatcggcggcaagctctgtcttgtccacggcatactcattgggcgtggcctgccggtcatccatcagggcctccgcgttctttttagaacggatgaaggcgcttttcatgcgctggcctacaacagcggacttgtccagtaccttaatgtctttacccttttcacgggttttaattttgcttttgctcatggcgtcacaccaatccgtcttttcatccaacagtgtttccgctctgcgggggcaacatagtagtccctgtggcgctggcccgtccacacctggcctccggctacgcccggtgatagagtccaactccacgccgtacagcttgcttccctgatactgctccggcagcacggaatagaaattgccggttcccatgccggggtcaagaatcctgcggtcggggccgccctcaaacccgaaccgttccaaagcacggtacatatagcggatcagctccggctcggtgtagtaggcggtgatggtggagcgcatggccgccttatattcttcctcggtcaacagggcctttaactcctgatattcgctttcccacccggccgctttatcggaaaaagcgttggcaaggccgccccagcccacatatcgggcaagggtgatctgttcctccggggtggccgtcctctgctccgcctcaatctgcttcaaggtcttgattgccaggatgttgtttttatatttggtcttggcgcctccgggatagaggtcatagtccgtggaaaagcggaagttgcgggggatgaacggttccggccggggattggctggcggttcagtgaccgtcctttcttccggttgtgtgggcggcacaccctccatgcggacaaaggcccgcacaggccgaagctcgtccagttccttttccagccggtattgaatgtcctctaaatcatccatatcagcggcttccgctggggagaggatgccgccgccctccatccgctgcacatagccatcgtacaggcgggtaatgtcctccagatcagtcttgaccttttgatattccgggttgggttgttcgtccaccaccgcccggtagagggcggaaccgtcctccgtcagatagccccactcgatttcttcatcgggatactgtccttgcagataacggagcatttgagtggcgatcccctgacggcggtaatcctccagcacctcgatcatgctgatatggggccgttcctcgaaaatgctgtacctcagggtgcccactgtcagttccccacggacggcttgcatgagcctatcaatctgaccgctgtgggcgcccagcgcttcatccagtatccgggtttcctctggctgctccggggctgccatgcggcgggcgtaagcgtcgatggtttccggggagagccaatccggtttttccggcagttgagcgtacagctcccgcattttggcgatctgcgcctccacactgcccgcccacaggtgcttttccgcccgctgcccttcacccagaaaatactcgcagtcagcacacagacggtctaacagacggtattcggcgctgaacggctgcgtctcatccttctgctccggctcactggcggcaggggcctccagatagcgcccctcatccaccaggcgttgaacaataccggcagcctgcggccaggacagcttggtttcatgtggtccgccttgtgtatcttcccattcgattgtgataccgtcaccattgaatagagagtatttcacacccagttcctcgctggaaaagccctcatatccatataactgttttaggaaagtaacaaaggccgaacctgtggggtgagtcagggcaaagtgataaatctgctcttttttaccttcggtgagcggacctttctgcaagacgcgctcaatcagcagatcttccgggcttctttcaggaggcggggccagcagggaaagctgctccggttcctcggcttctgcggctggggctgcttcgggggctggccgcagctccacatctacttcctcatcgttgaccagcatggtggcgcgtaccggctcatagccctgactggcgatgttgttcagccaggtggcgaagaactgtccaaacccggtgatcttcttttcctgcgccgggtctgcggggtcagcctcctgatacacgccgatgccgctgttttcatagctgaacgcccgcagggtcccggcctccgtgtcaatcaggaagtccatataggggtcatacattcggtcgccgttctgcatatagtaatgttccatgcagtagtaatcaccgtatttgtgatggatcaccaggggatcataggcgtccccagcctccaaacgcagagattcatactggccggatacgatctccgggaacagcttttgaaaacgccggaagttcttgtgggcggtggtattccctctggactcatgtggggatggagattcttccgctggtggagtcagattagcttgatctgccgccacgatgacctgttgcccgccagcaaccggctctggcacaaaggtgtctatttcatccgcctttgggattcccttaatttctgtaaataccgcctgcgggcggactggttcttccgccgtttcaccggcttcataggctacagcgcccagaacatagtcatagtcggcctgcccaatctcacgctgggggccgccgcccatttcttctacttcatcaggaatgttataagccccgatggggtcagattcttcctccgcggttatatccgggtaagcgcctgtttcgatcagggcgtccagcagattggcaaggctgggccaggggaagtaggtgtagccatcgtcaaagtaaaaggaaatgccgtcctctccacggggctttgtgcggtacagcacctccccctgaaactcccggtcgccataggccgagaacaggccgcagacctcccggcctttttccgtccagttgtagtctgtaacgccatccgccaacaccgcccgcaccgcttgatggagttcagggggatagaggtcggtgctggtcaggatatgctcatagtggcggcggacttcttcatcggaaaagtgatgttcaaccttcggggaagcagaaagagagccgtcctgtgcgggcggctctccttcatgctccgcgccttgcggcgcctcggtatgcggttgttcttcggtcagcgggggatcagcacgatagtctggagtaccgtttcctccgccatcagtttcagattgttcaggtggcgtgttcgctccagaatgtccttggtctgcggcatcggttcctgctgaagcatctgctgggtcagggcctcgatcttctccgtggcctcgttctgtacccggtgcatgacctccatcagactgccatccattttcaaaatcgtatatcgctccggctggttgtccttgagatattccagcgccatccgcccgtaccggcctaggggcctgtctgcctcgctgttgttggagatttgcaggtcggggagaagcatcccctcctgttctttgtaatgcagattgatgttcggcttgctcatgctgcaccttcctttcccgattgatgatcctgatattccgctccatctccaaaagcaccgcttttgaaatggaggtaactgccatacccagatgggcaactagcggaaccgtgttgaaatgattgaccgtcgccatcccatcgcccatgcggatcgcctcatctggcaagtggcatttcttaccgatgaaataggaaacgctgtcgctcaaaagctggatatactgcgcttcaaagccgccagccggtatttcctcaaacagatggtttttggtttcctgccgaagcccctgcaaataatgctcgtagttgtcattgacggcctcacgcgccagggcgtacaagaggtctgggaacggctgtgtctgaaacccatgtgagaaggtaagcctttcccccagagccttttgcatctcatcggaaagctgccagttggtgggatgaatctccttgcccatagtttgacttatatcaaagagatagtcaagcgtaaggcgggcgttgctgtaaacgcagacggcaatcccttttggacgggagatcaggtttctgcctacgccagcccactgttttttggtggcaaggatagtcacatcctcgtcctgtgcgtagaccagcagaatattgtcaaagctctgcttgtggaaccgggacgcaaaggccaggtaatcccgccagttcctctcgctgcggacgatatagggggccatgacctcataaatcgtccgcaggcgttcatcgtttctcaataggctcctccttcctgtggtggttttccagtttagacggctgtggcctctttacgggcaaagtagagggcaagggcctcgtctacaatactgtcaaattctttctggctgatgctggcggtaaagtatttcttgtaaatcgccggtttgactttgaacgccgcagccgtggatttcttgggcttccgattaaactcgccggagaggatttgttccgcccgttccggggtcagcttgccggtgtattcccgcagcagaacagctttgccctcgttgaccttatactcgctttccgacagaactgcctccaccatctgctgttcctcttgggccagataggagagctgaaccgccgccgcaatcgtaaattctccatcgtcgatcctgattttcaaggcggcagataattcattgatgcggagataattcgccacagcacggcctttcaggttgtactcagcccccacaacatcccggcttttggacttgtggcagtcaatgccacaagtcttgttttccctgatttcatcagggttttccagtcttttcagttcctcgataatatcgttccggcgcccctgacaaatcatcttggagtagcgcagggccagcacagccgcccgttcagacgggaacatttccgagaaggaccgttgcaggacattggtttcaatgacataaatccatgcgtcctgatcggaaagattctctttaacgatacagggaagtaggcgcttcgccgcaatagcagcattttggcggttatgaccggccagcatttcgtattcaaacccattttcatccggttcaatctttcggatgattgtgggactcaaaactccattttctgaaacgctgtctaccaggtcattaaatcggtcgccctcatacagccggaaggggtgtccccggaaaccacggatgatctctggcggaagcatttgaatttcgttatttccaggctgggcaggcttgtcctccgttgccgccgtgttctccaccttccgcgcaacccccagaaggtcgtccagagaacggatacggggattgatgttaggcatacgcaagcacctcctttgccaaattcatataggctgcggctgcggggcttttggcgtccagctccatcacgctgagtcccttgctgtttgcggtccccacctgaacggtagctggaatctgactctcaaaaatggggaggtggccgaacacggaacgcacctgttcgctggtctggcggtatagggttgtccgtttactgcatttcgtgaacaggatgccaatgatctccacctttggattcaaattttgcttgattttggagatcgtttccgtcaactccttcaagcccaccagagcgaacagctccgggtcaacgggaatgatgatctcgtccgccgcagtaaaggcgttgatggtgagcgagccgagggacgggccggtgtccaccaggatgtagtcataatccgcccggagaggcgccagcagcttggcaaggcaatcgtcctttcgctcaatcaacaggttcacctctgccacggtcagcgtttttttggacgggagcaggtccaccttgcctatgttcaggatgtaactggccttttccggcagaacttcatccatgactaatttcatcatcaggctggccgccgtctcctgcaaagcggctggtgccacgccaaagctgatcgtcagattggtttgggggtcgaagtccaccgccaatacttttttccccagctccgccagggagtaggccaggttccgggtactactggtctttgccacgccccctttctggtttgccatcacgataatcttacacacgggttctcaacctcctgttttcagtggatttacgctgtttcagcgcataaaaaaacttggactaaactcgcaccccgttattggagttctgactttagtccaagtatagctgtatcatccacatagaggccggccaccggcaccccccgctggcgggcaaagtcctccagcatggcccgctggttgctgacgctctctgagggcccgtcggtttcgtcctccctggacagccgaatataaagtgcggcgcggtacctctccgccccttctatctccaggtacatgagttacccccaggggtgtccctgttaagttcccgcgccaaaaaggcgcggaatgagccttgtaccaaatcctttgcctccgcccctccatcggtataggtacaccgtaccgtcacttcccgcttccgctgtcccaagcatatccctccttgctactgcttggtaaagcttatgcggcaggcggcattccttgcctgtccagtcaagcttaaagaaaggggcgtcccgatcgggacgcccctttctttaagctgttacattaaatgttctcgttctagaatcatagcccgaagaattctctgcaaaaactgtaacctctactttatattctttacctggggttccggtataataaagttcattcccgaaataataatcatcttttgtactcatgcccgaatcgtatctatccaaatcataccctacgacccacgcgcctccaattttataataaattataatactttctgctccaatatttttcatttcaccggttccgtcaatagaaaatgcgattgctatttttccatttcccgctggtactacatttatataataactcataatttgttcactcgctcggtttgtagactctgatatagcagatactgggatagagcagatcataagtagtaccattattactgcagcaaatctgtttgtcacttttctcataatatactaacctccatatatggaattgagcatctctttcaattcagtcaatgaaacatctccgctaattgcacattcaatattattttgattccatactgctatgtattttcctaaattctcaaatatataatgcgttacatctccgacaaaatattcctctaaggcattcgcatccttctcaaaagctgtcatggtacctgatgctatactattgtacacattataagtaaatgtaattagctctcttgtttgcccatttttataatgaatacgtaattctgtttttcctgaaaggacaaactcatttgttatgaccttttctaattcaaacccttctggaatccaggttggaaaaatattttcactataatttaattcccctaatatttcttctatatcaacactttttttatccgcttctatctcatttccctctaaactacttacgttattcaaaagaaatatgtcatctgtccacgcaccaatcaactgaaacacattctcgaaaccaagcgcagggggcaatgcgatacacaccaccacagccgctactatgacaacgcgtcgaaaaaagtggcgttttggccttctttggggccggtactctgtctgagagggggctggttctgatggggctgttccggggttctctgccgggtagagggacaggtcctccccctccggggtattatagtactgctgaaactcctcccatgcctgctcggggtcgggtagaagccctgtcggatgtctctcttctctctctaagaccacctccacaattgcgtctatataagctttgtcctcgggcgtttctgcgggcgccggcgcagcggccagcagctccagcagcttttgggtgctcaggcggcttagataggcgtagttctgatttttgcttgggcttgccattcgattgcgcccccttcaataatttatatgtacacagcatcctgtttttggacaggtctcaaaaaaatcgctccgggtgctcctctatggcgcggcggagctttttctgcgttcgctccacacgcttgtaacaggcccacagagaaatgccagccgcctttgccgcatccacataggtccaaccatccagggtcactctccggaacagggtaaaatcctcctcggagacgacatccagacacaactgcaccaattcgcggtcgctgtcgtcccattctgacggttcactctccggcagaagcacttccagcggaagaaaggtccgtttctggcgggcctgctcccgcagcatgttcttcgccaccagccccgccgttttccgcagccatccggcgggatttgggctgctcatcatctcctccggcttctggcacgcaatccgcgccgcttcctgaatggcaacctgtgccgagggcatgtcctttaatatggggtagagctcgaggagcatccgcttaaaattcgcgtggtagagttcctccaggaatttcccctgttcctcattcatgtatcattcccccctcgcctgttctctctctctttattttatcacaggtgctccggcttttcttccctgcattttaccggctgtctggcaggccctgaaaaaactcctcataagaaacgccgtaaatctgcttcaaagcgatcaggacgctgacccggatactgtagcggcccagttccatctgggagatgatttcccggctgacagggaggcccatgacctggagctttaccgcgacctgctcctgggacagtccggcctgcttgcgcaggcgatgcaggtttttgccaattgagatatcctgcttaattttctctgacatgaagacctccttaaaatcaagcctggaacctatggattccgtttgattttaccttggtatttgcgccagatacggaatgtattcattccaaacggctgtcaaagaaaaaaagtatcctattccgtggatattgtcgacttccttggaaattaaccccacaaaaaagcagattcctctcccatctttcaatcatttgtccaatttccctcttttgcgtacatatagtttttggaaagcctatcggaggtcaagcagcggatgcgctccatccaccagagggtcgcttgcggctcggtccacaccagtcatggacgctcccttacatctactttttgaaaaaaggagtctgtcctatgacaaatttcaccctgtcacctacttttgacgcggcaaatgcctctcaaaaggcagagctgctcctgcgccggctgggcgtgcgcagaaacctggtcggatttgactacaccgtatacatgtctgtgcaggtggcggccaatcccagctccctccagttgatcaccaagcgtctctaccgggaaaccgccaagcagttccataccacctcaatcgcggtggagcgcgctgtccgcaccgtaatcggggactgctggaaacttgaggaccacagccttctggataccctggccggacggcacctgacccgcagtccctccaacagcgtattcattgacctggtggccggatacctccggtatccgctgagctgactgtaccactggtgttgatgtcggccgcacgtccggcactccgggcctccctccgagaagctggcttttcccgctctgacaccgcagtgagggtggcgtctccgtccgggccgtcccggcccccggagacatccccctccgcgcttgcaatagccgcggcgcgatacataggagcgggagatgccgcactgggccgcgatctcccgctgggtcaggggcgggcgggcattcaggccgtaccggagggtgatgatcatggcctcccgctcgtccaggcatcgcttgacgcaccggcgcaccttggcgcaggagtcacgggcatccagctcctccagcatattgtcgtccacgctgatggtgtccatcagcgacagggagttgccgtccccatccccgtcaatggaatccgacagggagacctccccctgcagcttccgctgggcgcggaagtgcatcaggatctcgttttcgatacagcgggaggcataggtggccaggcgcacgttcttgtccggcttgaaggtactgatccccttgatcagtccgatggtgccgatggagatcagatcgtcctgatccccgttgggtgtatagtactttttcatgatgtgcgccaccaggcgcaggttgtgctcgatgaggatgttccgggcctccagatcaccctgcgccatccgctccaggtacatccgctcctcctccgctttcagcggacgggggaaggagccgcttcccccaccggagaggcgcagggtgaagaacaggctgttgagcatcagcaaaatccacgcagtgaacatttgtcacacctccatagttccactctattccgcccgcgtctgtccctatgtcaacgatcctgttccatgcgggcttcccctgcggaacgtgaacgaaattgacggtttttcccccaatgcttttagtggaactgctaaatttttaaaaatcgctccctctatatttacgaaccgctgccagaaggctataatttatcgtggtcggaaatgagcaaaatttttcgaaaatttgaccgcggagtcagatttgggggagcattgtggatattgcgaatatagtcgccatgtttggcgccatcgccacgttcctgtttggtatgtccaccatgacggacggcctggagaagctctccagcggccggctggagcatatcctggagcgtcttaccagcaacgtattcaaaggggtccttctgggggccgtcgtcaccgggctgatccagagctccgccgccaccaccgtcatgtgcgtcggtttcgtcaacgcgggcatcatgaagctggagcagacagtgggcatcatcatgggcgccaacatcggcactaccgtcaccgcgcagttgctgcgcctgggtgatatcgacgcggacaacatcgtgatgatgttcctgcagccctccttcctggggcccattctggcggttgtgggcatcatcttctacatgttcatcaagggcgggcacaagcgcattgtgggccagatcgtgctgggcctgggcctgctgttcatcggcatgaacaccatgtcctccgccgtggagccgctgaaggatctgccggagttccagtcggtgtttaccgccttctccaatccccttctgggcgtagccgtgggagcggcggtcaccgccctgctccagagctcctccgcctctatgggcatactccaggccatcagcaccaccggcgtggtttccttcaacatcgccatgccgctgattatgggccagaacatcggcacctgcatcaccgcgctcatctcgtcggtgggcgcttccaaaaatgccaagcggaccgccatgattcacctctttttcaacatcatcggctcggtcttttttctggtggttctgtacgcgggcaacgccctgttccgctttccgttctgggaaaacaccatggacatgggctctatcgccaacctccacctggcgttcaacatcgcctgtactgccctgcttcttcccttccaccgccagctcgtcaagctggtcaaggcggtggtgcccggcgacgcggaggagcgggagctgtccgtgctggacgaccgtttcctgtcctccccctccctggcgctggagcgggcccacgatgcggtggtgcagatgagcgagttcgcccgggacaactaccggctggctgtggagctcatctggaaatttgacgccaagaagctggagcggctcaacgaaaccgaggtggcgctggacaagctggagggtctgctggacaactatctggtcaagctcaccgaccgggcgctgaccgccgaggagagcacccgggtgtccgagctgctgcacaccctgtccgactttgagcgcatcggcgattacgctgtcaacgtctcggagagcgcggtcgtcctccacgaccggaacattaccttctccccccaggcccgggccgagcttgagaggctcaccgcggcggtgggagagacgctggacaagacggtagcctgctaccagagccgccagcgcaccctggctgtccaggtggagccgctggaggaggttgtagatctgatcgccgccaccctgaaaaaccgccatgtggagcgccttaaggccggtgagtgcaccatcgagctgggcacccagttcctggagctgctgatcaatctggagcgcatgtccgaccactgttccaacgtggctctgcacatcctgcgccagacctcctcgcccgacgacaaggtgcgcatcgactcccacgcctatatgcacgagctgcatcacggcggtttcaaccaggagtttgacgacctctttcaggagtaccggacaaaatacttccagcccattgccggggacccggagcgcgtttgataaaaaagtaccccctgccgcatgcggcagggggtactttttgctattcataagcatagcaaagttggccatgcgccgcttaccgcggcacggccatgcgattacgggacggcccgcatgcgcaaacacttcatgcacctgagcttttgcattttttcgtggtgcgccctgttggagtgttatacgccttcaccggtcacgtcgcagaactccggctcctcccccagcgcgaactggagggggcggtctcccttcagcaggcgtgagagctccacatagcgcacccggctgttccggtaagtgagccagtagaagcgcatggactcggcgcagaggacggaggaatacaccgtgtagtcatagggcaccacgccccggtcgtggggggtgatctcccccggcccggtgagctccaccgcacccagaggaaaggcggcgctgtggagcaggcggaacagaagggacaccccctccgcttcgtccccgcccttgaccgcgtgctcccggaggaaggccagccgcacgaagcgggagggggacgaccagtccccgggcaggccggccgccccgctgccggaaaagcagggctccagccgttccccgccccaggccagctctccgtaatccagggaccggagctggggatagttcaacagattggtacggtgccacgggtagccggggctgttggtcatcaccccaaccgtgttccggtagatgtgcagcccgtcccggtcggactccaccacgatgctctccccggtgcggtcggaaaacatccagtggatgggcggcacggtccccagcatggggatggccaccagcgacacccgctcctccagtgcgcgggccacctcctccaccgaggcgcaggtggccaggcaccaggtcaccaggaagggcggctggaggggcagggtgccgggccgcgcctccggggcaaagtgggcaaacgtgcggtagtagagctggccgcccatcagtcccttctcgttgaggccctcatacagggccggggtggaacgcagcaccagggagccgatgcccaccgcagcgtaggccgccgtacagcgggtggacggctccagattgccctccagctcggtaccgcaggcgtagaacacctgtccccgtggtacaaaggtcaccttgctgtccgccgcaatgcggttgaaatcgaagttgcgcccccacaggtgtccgccgtccgccgtctcccacgccaccgcgctgcacccggcggacaggtcgcccagcagcgcccgcgcccggctctcgttagaatccatctgttacgcctccttctggaacctatgtgcttatggtatacggtctgtcactgattatacacctttttcccctttcccgccaccagcaaaaggagcaccccggcagccagaagcagcccttggacggcccaggccgccgccgggagggagaaagccgggtccagcatccccagagtcaggggataggacgtgcacaggccgccgttccacagccccagggcctccggcagaggcagggccgccagggcaaaggggaggagcatccacacatagagcagccagggccgcaggcggcccagcagccagccgctgcccagggcgaacaccagagggggcgccaggatcaccagggcaggcagggccagggagccccagtccgtccagccgaacaggcgggcatagagcagggcggccagggccagcgcctccaggcagagcagagccacccccaccagggcggcagcgcagcgggccagggcgtaccgccgggggtcggcgggggtggcggcggtgagcaccgccgcccgccgctcccgggccgacgtgaaaaaggtgaggaagaacagggcccccacccacacaaggggcagcagccgccccaggtaggccccgaagctccagggcgaaaagggggccgtatgggccacgccggggagggctacggcgtagaacacctgtccggcatagaacagcagcaccgccagcaggccgatgaaaaacttgttgcacagcagccgccggcactcgcagcgaaatatcttaatcaagggtcaagtcctcctccgtcagcccgcaggcgtccaaaaattcctggtaggtcagataggggtacatggggtccagctcccggttgaagaggccgtgcaggagctcatccatggccgcctcgccccccaccagctcctccgctttcaaaatcttcagcggcatctcgctgtaccggcgcatgccggacagggagttggagatggccagccgctccgcctcgggcagggcctccaggtactccgggcggcggacgtagaagttgaggtagtagtcctccacctccgcacgccactggttcacatagtgctccctggcgtagtcctcgccgtagagctccttcgcgatgcggtaggtggtgtagcacgtcaggccctccgccgaccaggggtcggcggtgtcaaacatgttgcccaagccccaccactggtggaccagctcgtggatcatcacctcggcggccccgccgcccttgtctgcgtcgcccaggttgtgggcggtgaagtcggcctcgtccagcaggctggccccgtccccggcgtagccgccgccggccacccggctctggatcagcttgaggcgctccccatccccgaaggcaagagaaccgtagtgcccggcgcagtagtccatcaccgccaggacggcctccgccgcgccggcggcctccatgacggcctggtgcttgcggccgtagtagaagtcgatggtgagccccccggcctggatctcctcacgaacgtagtcgccggcgtagaggatgccgccggcacggttggtctcatagcgccaggtcttggtgccgtccccatgttcggccaccacctccgcctcgctggcgccgaaggggatgaccgtcatggcggcgggcagggtgatctcaattgtggcgggatagccgtcttcgcctggcatcacgttcatcaggcggggagagagggccgcgttctccagacagaggtattcgccgctgagctccttgctcccttgcatggtgggcatgctctcctgggggaagccgccgtactccagggtcagctccacctgctcctcggccgggatggcgacctccagtttggcctcgttgtactcctggtaatcgctcaccgagaaggggacctccaccccgttggcccggacgttggagatggtgtagccgggggtgacgccgagggccaccgtctgctcctgccccgtggtattctggagctggtaggaggccgtaccctccaccgtgccccgccttgtgtccggcgtgacctggacggagcggcgcaggcaggccaccccctccagcggttccatcgtcaggaaggtcatggcgctgagatccgggttgctgtggtcgatgaagggctgagcggcacagctccagccgcagcagagcagcagggccgcggccagcagggggcggtatacccgccgggccgtgcgggccagagagcccagggggccccggccgtaccgccggatgcacaggtaggacagggcccacagccccgccaggcccagcagccaggtcaggcgcatgtaggcggcggagcggaggatgcggaagttggagaaatcgtcggacagggcccagacgcaggggttgagccagcagagctgccagttgtcccgccagatggtgaggctcagggccgccagagcggccaccagcaccagggacaggtcaaagcggcgggtgaactgccacgctgccccggccagcaggatacacagggggagtgccaggcccatgagaatgaggtaggccagcagataatccccgccgtcaaagacggcgcccacggtatgggccgtccagggcagccaggtcagaagggtgagggccagggtcagcgccgccgtccctagcagggccatcagccttgccagggcagcggtcaggggagacaccgccgcgtcgcagagcacctccacccggcagcgggaggtacgggcgcagtcgcagagggtgagcagggcaaagaacagcccgcccagcacgcccccggccagggcgggattggccacatagagggactgcatcgtgtcggccgaggcggaccggtacaccgtcagccccgccaggggggacaggacggtgagggcggcggccagccaggtgagccggccccgcagcagccgcgccagctcccgcaccgagagaatccagacgttcatgcctcgccctccccggagatgagatagaggtaggcgtcctccagggtgggctcggcgggccggacataggggggcagcgtctccgccaccgcccgacaggccacgccccgggcggtgttcacccgggcggtgatgtgcaggccgtcctcccggccccccgcccgcgcctcaaaggtgcccacgtggccctctgccgcccggataagctcctccggcgtgccgtcgaagcgcagccgcccctggtggagcaccagcaggcgggagcacaccgactgcacatcctcgatgatgtgggtggacaggagcaccagccggtcctgggccagccgggaaaacaggttgcggaagtgaatgcgctcctccgggtccaggcccaccgtgggctcgtcaaagatcaaaaacgccgggtcgcccagcagggcctgggcaatgcccacccgctggcgctggccgccggagagggtgcggattctggcccgccgcttcttccccagatggacagcctcgatcaccgcccgaatgctctcccggccgctccgcaggcccttcagcgcccccatgtagtccagaaactgctccaccgtcagctcgtcaaacagaccgaagtcctggggcagatagcccaggcgggccttgtaggcccgctcgcatttggtcagaggctcgccgtccgcccgtatggcgccgccggtgggcagcaggcccgccaccagcagcttcatcagggtggatttgcccgcgccgttggggcccagcaggccgatcaggctggggctgtccagggaggcgctcaccccctggagggccttcttgccgttgggataggtcatgttcagttcttgcagggtaatttgcatggctcggcatcctttcttgtttgggttcgtcccaaggataccggccccccgtggaggagagagggagaatttatgtgttttctgtggagaggcgcggaatgagggcggtgaagcgcaccccgtcggcgctgttctcaatgcggcacgtcccgccgtggcgctccacgatcatgcgcaccagatagagccccaggccgctgccgccggtggcccggctgcgggagggctcggcccggtaaaaggcctcaaacaggtggggaagggcctcggccgggatgcgggccccggtgttttccaccgtcagcaccacctgagctccccggcccgccgcagtcacccggatctccgctccctccggcgagtagagggcggcgttggagagcaggttttccaccgcacggcccagcagggcgcgctccccctccaccagaagtcccggctccagcgcctccaacacggtcatcccccgctgctccagcagctcggcgtcctgggccagcttctccgccgtcagggcggacagctccaccacctcccggcgggaggcgccgtccgactccatgcgggacacggccagcagctcccccaccagcgcctccatccgccccgccacctggagggagcgggccagatacttctcccggtcccggtacacccccacgccgtccagcataccgctcagctgccccttcaggatggtgacgggggtcttgagctcgtgggaggcggcggagaagaaggccagccgctggcgttccagctccctggcccgctccatgtcgccccgcagggccgcgttggcctcctccagctcggccagggcggcggagaggcgctccgccatctcatccaagctgcggcccagagcgccgatctcgtcccgccgggtctcgccgcatttccactggaagtccagctccgccatccgccccgcgatggagctgatgcggacgatgggcctggccagatagcgggagtaccctaccgcgcacagcagggaaaaggccaacagggccagggccaggcagggcgccgcccggttgagggcctccaccgcctggttggccaggcgcatgggagggacaaccagcagttgataggtttccgtccggtcggcaaaggtcacctccgcgatcagggcgtcgctgagagccgtggtcacatagtgcccggtccgttccccctgtgccgggccgccgtcggcgccataggtataggtggacaccgaatcagactcctgcacggccgtggtgacggacacatagagggaacccgtgtccacactctccccgtcggggctcgccagggataccgccgctccgctctcccggacaaatacatccaggatgggcccggcgtcggccagcttggttagggccagccggtcggtgagctcgttcacctgcacctggagccggtcgccgaccacggacacataggtgatgggggtggcccaggcgatcagtccgaaggtgagtccccccgcccccagcagcagcagcagggtgagcaggaagatacgggccgtcaggctctcacggatgttccttcggcacacggtagcccacccccctcacagtctcaatgtagtccacccccagctttttgcggaggttcttgatgtggctgtccaccacccgctcgtccccgaaaaagtcgtagccccacagcttggccagcagaatttcccgggtaaacacccgcccggggctggacaggagctcccgcagcagctcgaactcccgggcggtgagctgctccagcacccggccgtccaggcgtacctccaccgcgtcggggtccagggtcagcccccggtagcgcaggcagcgtccgggcgcgtcgccacccgcccgccgcagcaccgccgccagcttccgcagcaggatgggcatggagaagggcttggtgatgtagtcgtcgatctccagatcaaagccccggagctgctcagcctctccgtccagggcggtgagcaggacaatgggcacccgggactggcggcggataagctcgcacaccccaaagccgtccagcttgggcagcatcacgtccagcaggaccaggtcgaacgcctcctgctgaaagaggctcaccgcctcaatgccgtcccccgccgttgccgtctcatagcccgcgtcgcccaggtaggcctccagcagctcctggatgtcctgctcgtcctccacaatcaaaatgcgtttcactgcgaatcactcccgaaacagatggtagcacataattgtgaattttgtatggagaaggtttcccgcgctgcggccagaaaataccgctgtcccccttttcttctcaggggaatgatacggccccttcctgcttttcaagcatagcgcagaaaggccctggttccgcacgtaagcagatgccccgccggcagtccaggctgccggcggggccctctcccctattgtttggaaatacttacggccgttggcgtggagtcctccttgcccagctctccggtataggtgacggatacgcagtctccctcctccagtgcgcctgtgtccactcccgctccgaattcaaaggcctggtactccccctcgtccgtcaggagcaccaaaaagtcgccgttccggttcacaactccctccaccgtgccgcccgcagcgccctccctgtccgtgccgcaggccgtcagtatggccagcaggagcagcaccgatatcagtctcaggtatctctgtctcatgttcctccgcctttctcattggaatttttcgggcagcgtctgtcccgccatagcatagcaggccgcgatcctctcccagtccagccccgcttcattcccgtccagaaagcccgtcaggccccggagcatggtgtcctgtacctcggcggacgcgccggccaggtgttcctccaggaaagcaaggataggctccacctccacagtagtttgaagaagatcattgtacccgtccagcagaaccgcactctggtaagcctcctccgtctcatagcagaccggcacgttgttgccggtgcgccgctccacgatcaggcccgccgccccccggtcaccggcggcccgctcggccttctcccgggtgtcatactggcccagctccacaaaaagccgacctgcgtcgtcccgcagcaggcgcgccccctcctccggcgcggccatggccctgagggcctccgggctgtccgccgacagggtacgcagtgagtagatggtgtccagccggttctctgcgggagtcaggcggatcacaatactgcccggctcctggtactcccggagctgcacatctgcgtcgctctccagctccagttggaccacggcggcgctgtccacccacccctcggcggtgtaaacagacttgatgtactggctggtgtcctgggcgcgggagagctccgacaggatctccacccgctccgtcccgggcagggtcagcgtgaccgtcttgggaaaagaggcgaattcggcgtggtagcgcccggcgctggactgctcgtagcggagggtcagccactccgtatcgccctcccgctccatggtcagggccgcccggctgcctgcggcagtctgtccgccgtccacgctgggcgcattgacccggaacacctgcaccagtctgcccagaatcggcagctcctccatggcggccgcgaaggccggcgaggcgttcacccctccggcaaacaggcccagcaccagtgccaggcacagggccgaccggacggccccccgccgcacccgcgcccgccgggccaccgtgcgccgcccacgctccaggccggtgcgaatggcggtatccagcccctgcggcaggtttccttcggatgtctgtatcatatctgtgtcgtcctttccttcaattgattcatcccccggtagtaatcggatttcacggtactctccggcttgcggagcacctgggcgatctcccggaaggtcatatcctcgtaaaatttcaggagaatgacggttcggcttcggtcatccagccgccccagctcctccctcagccagagggagtctgcccaccgctcctcaccgtcctcagccgggagcgcgtcccacgcctcctgcacagccccctgcgggggccgccggcggaggaaggacagcgccgtattggtcagtattcggtaaaaccaggggtaaaagcgttcggggtcccgaagcctccacttggcggtgtacgccttgcagacggcctcctgaaccacctccagggcgtcgtcctcatttcgtgtatacccaaaggccacccggtaaaaggatgcctttttctgctcaatccgttccacaaattccgagtcggagatggaaggatgcgagaattgcagctgcacgtgttttgctcactcctttctgcctaataagacgcggaaagccagcccttagtcggccccacaggaaattttctctaaaattttatcgtccctggcccctctatgtaaagagcctgccccctgtttgaaaagggggcaggctctgtttgatcaccgaactattgggatgcttcgtccaggaactggcctaactgcgtcacaggctcctgactgaccttgcggatggatatgtgggtagcgtggagacatcgttcccccggatggatgacacgccggaacttcatgttgaaaccggccgcctgttataaaatttgagaaataaaaacgggaggccagccctgatatgtacccagaattctggacacataaaaaattgaattaggtgcacatggatgcctctctgaattttgtaggaggcatccattttgttttctcttggattctttcgttgttgtagtaatttatgtagccgtcaacagccttggcaaatgtttcaaaagaggaatactctttttcatgcccgtagaacatctcgtttttcatccgtccaaagaaggtctccatgatgcaattgtcgtaacagttgcccttccttgacatggattgaatgattttgtgatctttaagtgcctgcctgaagtacacgtgctggtactgccacccttgatcagagtgaaagatcaggccatctacagagggaaacttcgtaaaggcgccggccaacattctctggatctgttccatattggcactttgagataaatcataagaaatgatttcgtttgtgttcatgtcgagtataggagagagataacacttcccccacgaaaaaccgaactgagatacatcggtagtccatttttgcataggagctgtcgtgctgaaatcccggtcaaggatattctcagcaaccttgccgacctcgcccttgtaggaatgatacttttcctttgggcgctttcctgccaaccccatagtgtgcataagccgttgtacccgcttatgattgaccttgtggccgcgctttatcagttcctgatatactcttcgcacaccgtagcggcctttatgctgtgagaaaatgtctttgatttcatctgccaagcaatggtttcgaacagcaacttgatcggccttgctcaactcaaaataataggtagaccgtgccatctgcatagatttcaacagatatttcaattggtatcctttttcacgcagctctttgatgatcgctgctttctcgccttgagttgcgctgcgtgcctctcttctctcaaggcgatctctttttttataacttcattctccgcctttatatactcgttttctgcccgaagccggatcaattcttctcgttcggattcattcagtggccttgcttcttcctttttcatttggggtacccctttacttggacgaccttttttcatttctaccaggccattatacccctttgttttatagttttgaacccattgatacaatagtctatcttgaataccggcctcgattgccactgacacacaggattttccggacattacttgggatactagttccagccgttcttctggtgtccagttcctgttgaaatttttgtgtttcagtgcttctggaccgcggctatcctctgctcttacccatagtctcactttatcccgaaaggatttatcgctaacaccttccggcgtttctggccattttccttctcgatacagttctacacatttccttttgtactcatacgtgtaccgcataataataccccccctactgggtgtccagtaaagggggtacatatcacccctgcgggccggtcccccgttctgttctgctcagtatccctcggcgtgctcgcccttcaccagcttgacgatccgggacgtgcccaggcgatccgcgcccagggccatgaagtcctcggcgtcctggaggctggagatgccgcccgcggccttgatcttcacgccggggccgatgtgggccttgaacagggccacatcctcccgggtggcgccgccggtagagaagccggtggaggtcttgatgtagtccgcgccggactcggtcaccagctcgcacagcttgatcttctccgcctcggtgagcagacaggtttccacgatcaccttgaggatgcggccctggcaggaggctttgatggccttgatctcggccagcacctcatcccaccgctgatccttcacccagccgatgttgatcaccatgtcgatctcgtcggcgccgttgcggatggcgtcctcggtctcaaagaccttgacggcggtggtagagtagccgttggggaaaccgatgacagtgcagatcttcagctcgttgcccacgtagtccgccgcctgcttcacaaaggaggcgggaatgcacacggaggcgcagccgtacttcagcccgtcgtcgcagacctccttgatctgggcccaggtggactcctgtttgagcagagtgtggtcgcagtgggccaggatgttcttcacgtccattagattactccctttctacgcgtcgtgcagttattttacctctaccagctcgtaggagcgggtgccgatgccgattttctcacagtggtccaggcacacccgccagtcggtgtccggcatgctgttgatgaagtggtcgtgcttgtcgcagaagccctccctgtgcatctgctcgtccaggtgggagccggggatgggggactgtttcccgcaggcgtcggcgcaggcctggtccagagccaccgggtcaaaggaggcgaacatgcccacgtcgggcacgatgggcaggtcgttctccccgtgacagtcgcagtagggggacacgtcgatgaccaggctgatgtggaactggggacggccgtccaccaccgccttggcgtactccgccatgcggcagcccagctcctccatggccgcgtcgttgccggggcggatggcgtcggtgttgcacaccgcaatacagcggccgcagcccacgcacttgtcccagtcgatggacgccttgcggtcctccccaaaggtgatggcgccgtgggcgcactgggtggcgcaccggcggcagcccacacagcggcggggcgccaccatcggcttgccctgggcgtgctgctccatcttgccccggcgggaaccgcagcccatacccaagttcttgatggcgccgccaaagccggtctgctcatgccccttgaagtgggacagggagatgatcacatcggcctccatgatggcctttccgatcttggcggtctggatgtactccgccccctccacgggcacctccacgtcgtcgttgccccgcaagccgtcgccgatgatcacctggcagccggtggacagcggggagaagccgttctcataggctgcgtccaggtgctccagggcgtttttccggcggccgggatagagggtgttgcagtcggtgaggaaggggacgccccctaggctcttcaccacatcggccaccaccttggcgtaattgggccgcaggaatgccaggtttcccggctcgccgaagtgcatcttgatggccaccagcttacgctcaaagttgatctccccgatgcccgccgtgcgcatcagcttctccagcttgttcagcaggctgacccccggcctgcaccggaggtccgtcatgtaaaccttggaccgctctcccatatttctgtgtgcctcccattttggttcaaattgttaagtggttcttattttatacccctttgcccgttctcgcaaggggtttgcgctgaaacataagcaaaaaggccgccaaaaggagcacgcaggcccccaacaccgccctctgcccccaccggccgctgcaccaggcccccagcgccgctccgacaatgaaaaacacgataatgccgtagtactgggccgcccggtgtccgtggtcccgctcgccggtcttcccccataggtacagccgctccgtgccgctgcgcaggtttccggtgcacatagtggtggcaaaggcgttgccgttgaccttgcggaagctctccacctggaccgcgcagacaaaggccaccagcacattggccgcgttgtccagcgccgcgggcaggaaggccaccgccgccagcaggagcagctccgccgccacggtgatctgccgccagtggagggcctgggccccccggaaccgtccgcggatcagctctgccgccagtacccccgcggcaaaggccagaatgggtaccagatagtggcctgcgccgccccagtccccctccatcagccgtacccccagcagcacgatatttccggtctgggcgttggcgaacactccaccccggataaggtaggtatacgcatccagaaagcctccggtcagggccagcaccgcccccagccgaaagctctccgacatctgtctgtgtgtcgtctgttccacgcgctgtccccctttcaggaccaaaggtccgctgccagcttgtcgaaaaggtgtttcgacaagctggcgggctttctaaaattaacataaaataataaaaagtcgtttgatccaacgcgaaagggaaccctgacggttccctttcacactatctttcccctccaaatccttcggcaggagggtttatcggcagtcttaggggcgggcctttggcccgtccccctgtgtccggctcagaacggcaggccgagccctccggtgagctgctgcatggtggaggcggagtcgctctccgctgcccgcaaagcctcgttcaccgcggccacaatcatgtcctgaagcatctccacgtcctccgggtccaccgcctcgggggcaatgacgacctccttcagctcccgcttgccggtcaccgtggcggagaccacgccgccgcccgcggcggccgtgtatgtcttggtctccagctcctgctgcattttcatcatgtcctgctgcatcttctgaacctgcttcatcatgttcatattcatgccgccgccaaagccgcccattccgcggctgttgaatccctttgccatcggtcgcaactccttttattcctgaatgatgatgttgtcaaactgccggctgaacgccagcagatcgtccagtttgtcgtgctccgccgcctgggcgggtgccgctgcggccggggcagcgggcgccttccccaccttgaccgcgcagcgcgccgggacgccggtctgagccgaggccagccgccccagctcctccagaatggaggctccgcccaccatgctcttggtaaactcgtccttcacccacagcgtgagcaccccgtcctccagccgcccctgcaccatggccgggttgctcaggaaggggtagaccgcaggaaattttccccgcaccgccgccaccaggccgggccaaaggtcggccgcggcgctccggccggcttctccgccggtgggcgcctctccggccaccaggcggtcctcaggagctgcagacggctccggcgtctcgtctacgtctacccgctcccccggctcatcaggcagtgggggccgctcctcctccaacggggggcgctctgccgggactggctccgcccttggggcggacggctcccgcttcgccggtgcggactgcttcatgggctgccccggtaccgcgcaggccgccggaatcccccccgccagcagctcctccacccgggccagccgggcattcagcgccgcggtgctctcgtccaggcccgggtcgcaaaggcggatgaggcacagctccgtgtccgtccggcggttgccgctgcgggacagatctgcgatggtggtctgaagcaggcccagcatctgtaccagccgggccgtctggaactggttggacaggcggcgcatcgtattttcgtcatagccgccggtgagcagggccgcgcccccctggggggccgtctttcggatgagcagatcccgggtcagggcggacagctcgcccagcagagagcccacgtccttccccgcgccgtacagccgggccagggtctccagggccccggcggtgtctcccccgccgagctgctccatgagccgcgccgtctccaggttgcccgccagccccagggcgtccagcacctcctgctccccgatggggccggatggaccggcgcactggtccagcagggacagtgcgtcccgcaggccgccgtcggccagcctggccagcaggctggccccctccccccgcagctcaatgccctcctcccgggccacataggccagccgggcagcgatgtcgccggggagaatccgcttgaaggagaactgctggcaccgggacttgatggtggccggcaccttgtgcagctccgtggtggccaaaatgaacataaggtgctccggcggctcctccaaaatcttcagcagcgcgttgaaggccgcagtggagagcatgtgcacctcatccacaatatacacccgcttgcgcactgccgccggggtgtataccgcctcgtcccgcagggcgcgcacctggtccacgccgttattggaggcggcgtccagctccagcacatccaggatggagccgctctcaatgcccaggcaggacggacactggttgcagggattgccgtccaccgggtgttcacagttcaccgcccgggccaggatcttggcgcaggtggtcttgcccgttccccgggtgccggtaaacaggtaggcgtggctcagccggccggtggccacctggcgcttgagcgtgtcggtgatatgggactggcccaccacatcgtcaaaggtgcggggccgccatttgcggtacagggcctgatacaagggcggtcacctcaaatcaaatcaaaaaggagaggggcggaggatgcggaaagccgcgtcgcttcgcccctctcccgccgcgtccggcgcgtggcaagaccgcacaccggcctttggagactgcgctatacccgttacccaggcagccggctcaggagcgggacccccgcggcacaggtcgcggtccgcttagtgctgctcggttccccgcctgacacggttcacggtgcggccttgcgcgggaccgatccatcatcgctgcttacctggggcagacagcacaacgcagttccgggggccgggattcatccctgctgtagcgggttgcaggtacagggcaccgctaactccccgactagtgcggccttgccgcgggccggacgcctctgcgccgtccgtcggaaggctgtatttgatatcatacatcatttcccgccatttatcaatatcacttttcacttttttcaaaaagggtctttacaaccggataaattatgctataatatctgagtgtccacaacaaggatctttcattttgctgagagcactctgtatgggcctatagctcagctgggagagcgtacggttcgcatccgtaaggtcgtcggttcgatcccgattaggtccaccaaaatgtgtagacaaaaaagatacacggaagaaacaccgcacagaagtgcggtgtttcttctattttaaaaggttttagaggaaatcagcacaaaaaagtttaattttagaagtcagagcaaactttttcaaagaagggccctgggggtgatgcaaaatccagtttttagggaagtgagtgtttcgaactcctccgcattcggccagggcatacaagaagaaaaatcaagccgcctgttggcctcagaatacctgaagcccacaggcggcttttttcattccccgcagcactgttccttttagtgcttatgcttcgtctgttcgccattccttgatggtgttggtaatagcttttccctggctttccggctatacttgcgttgcaaacgacaagaaggaggccgacagactatggcagagacgaaaaatttatgcgcccagattcctctggagctccacgccaaagtatgcggtgagcgggagcagcgggaacagaccaccagccagtacatcacagagttactcatggaatactacgagatgaaagaaaatggaggtaagacgactatggcgaacaatggcagcaggacgatggccttccaaatcccggaggaactgttccagcggatcaagcagcacctggagcgcgagagcgcccgcagtggccgcaaggtgacccaacgggagttcgtcctgagtctgatcgaggaggccctggaacaggctgaggaggaagccgcagagaaggaggccacgcaggaaaagtgtggtgaggacgcatagcagccggagtgcgcccccaaaccaccctataacataagtcagagaaagccccccagggtgcccgaacgtagaatcgggtaccctggggggctttttgcgcttctgtggaaggagggaaaaaccatcgagcaacagaagaaccgctttacagacgcagaaatggagatcgccaaagagaccgatctcccagacctgctggagtccctgggctaccaggtcaggcgggtcggcagctaccacaccaccaaggagatggacagtctgcgcatcaaaaaccggcgcacctggtttcgttactcagagggcgtcggcggagacgccatcaccttcctccagcggttctgcggcaagagcttcccggaggcggtggaatatctgcttgactaccatggctgggcgcgggattcccccgcccctcaaaagtcggtgccgtccaaaggccaggacagacagaaggatgagcccccgcctccctttgccctgccactccccaatacggatcagcggcgcgtgtttgcctatcttcaaaaaaggggcatcgcgccccaggtgatccggggatttatccaggcaggactgctgtacgaggacgccgaacaccacaactgcgtgtttgtggggcggaacaggtctggaacttcggtgttcgccagcaagcgcggcacctatgaccggagcggccccggcttcaaaggcgacgtaactggcagcgacaagaatacggccttccgcctcccctgccgtccggagttaaatgcggttcttgtctttgaagcccccattgacctcatgagctattgtaccctgcaccggcaggtcaccagcaacgcggtggccctgtgcggactccatgagggggcgctggatacatacctgcgggagaatccgcagctcaggcacattgtcctgtgcctggacgcagatgagccgggccagtctgcagtggaacgcctgcgggccaagtacgaggccgcaggttacatggtgcagtcccggacgcctccttgcggcaaggactggaatgagtatttacagcagcgaggccccatccgggaaaggggggatctgcgacagactgtaaccagatgatcattcaggctgaaaagaacaaaacatggaggaacgatcatgatcaaacacctttttacaacgctgtgtgccctggccctgatcacggctgggagcatccccgccctggccgccgaggcggataccagtgagagcgcccgctattaccccatctcagtggaggagtacacctacgaggaacagaatgagccccgcatcaacaaggtgtaccagctctccctctcagacaacccctccggtattcccacaaaggatttcgtgcggaatgggcggttatattacctgctggatatgacccggaaggacgaggtgggggtggacaccaagccccatactgagaccgtcacccggcctagtgataccagcaacatggaggaaatcctccaggggctggaagccgagctggaggtcaccaccgaggagggctacaccggcgtgctccgcctggaccacaccagcgtccaggtgaccacagacggctatgccaccaagacccagcctctctccgccacccgcagttatcccaatctctccgaggcggacctctccctcatcccaaagagcatcgaggagaagggcaagaccctgaccctggcagatgtccagtggagcagttccgagcagacggacggcgcgggcggcacagtcacccgttacaccgctgcagccagctacaccggtaccagcagctaccaatatgctaccggctacacggtcaccgccaactacaccggcgaggtggccaagaccggctgcagcgtagtgacctataccgccatcttcggcagcatggaggccccggaggagtccactgagcctgaatcaggcaacagcacagcgtccgctggcgtggatctctccaccctgaagatgccgctgctggtcggcggtgtagtcgtcatcctggctgccggcggtgtgttcgtattcaagaagcttaaggagcggaggtgagttccgattgaaactgcgcgtctttctgctgacggcaatgatatgcaccctgtgcgttggtcaggccagcgcgctggaatacacgatggacgccccagaggatcacctgttcggcaggcccaccagcgatgatacgatctatgagtgggaagatcccaatgtggaccggagcaagaacacagccctgatcccgcccggcttcggcagcccaaccagctatctccccggctccggcacagccctgacccccaacctggttcccggtgcgttggagggcggcggcctggtatctcagacagggagcatcacttatccgactgtggacagcggtggcaactggagcggcccatcgtttaccgccgtcacaagcgatctctactactccggcggatacctggggacgctcaagatcccggccattggcctgtctgtcagggtctatgaaggaacggacagcggaaccctggccaaaggggccggtcacttccccggcaccagcatctgggatgggaatgtttgtgttgcaggccacaaccggggtgtacgggatgactttggagacctgcacaccctgaagccaggtgataccgttacctggaccaccaagctggggacaaggccctacgaagttgtttcggtggaaaaggtgctcgagaccgacaccagcggcaccacatccaccagcgacaaccgactcaccctttatacctgtgtcaaaaaccagcgggcttaccgctggtgtgtcaccgctgtggccaagtaatgctgtctgccgatttcgctcgactttccaccaaaacagtggtatggttcggagtgtagacccccactacacaggaaatggaggaagcgagtatgaaacataggaaatcggtatccctgctcctggctggcgccaccaccgtggccatgctgactggccctgtccaggcggcagaagcccccagtccccaggagctggccgccgcccggttgcagtccgaggggctcatgaagggagatgaaaacggcgaactgcacctggaggacgacctgacgcgggcggaactggcctgcctgatcagccccatcatcctgaacccggaacatgtggcctgggaaacggattggtacacccggatgtgtaccaccaatttcaacgatgttcctgaatgggcacaggtcgccgtgggcgtgtgcacctccatgggcacaatggccggatacggagacggcctgtttggcccctcagacccggtcagcccgcaaatggcctgcacagtcatgcttcgctacctagaacaggatggctggacctacgacaccgcctgtgaaaaggcagcggaactggggcttgccccagcgggatcgctggaaggagatgccatcacccgtggggatatggccatcctgctgaccggctccctggactacctggcatacctgcaaaccctgtaagaaaatactgcgttttccccaagcggcccccggtgtgtgttgcaccgggggccgctattttgcgtttaaggaggaatttcgaccatgatacggcgattactgtccctgttcctggcttttgtgaccatactcagcctcctgcccacggcggcctttgcggccagctctgaggaggatgccttgggcgaagtggacatctataacggcgactatgagctgggctacctcgccatcaacggcacggtcagaaaacagaaatacacctactttttgtacgaatccaatgatgggagcaccaaggaatctcccgcgtactgcgtgaacccgaaccagtacggcgtgccccagaccgtcggtcccggcgagagcatcaagtacctggccgaggaaaaggccagcgaccccaaggtggtgggcatcatctccaacggctatccccaccgcagcctgggagagcttggtctggagaacaaatatcaggcgttttacgccaccaaaatggcgctctggtgctacctgatccccagctgggacatttccaacctgaaggtggctcccggcctgtctgggagcgagctggacatcggcaaccgcatcctggccgcggccaaggacatctacaagcgcggcaccacctacaactatatgctcactccccggatgaccgtcacggcagacaagtccacagcctaccccgtgaccatcgacggccaggcatacttgcagcaggtgttcaccgtctggagtgagacttgggtgtatgactacgacgtgtccgtggccttctccgacccggacagtgtgccggagggcacgaagatcgtggacgccaacaacaaggagatcaccgccgtcaccacaaagtacacctcagacggctatgccgggacgttcaaggtcctctatcccgcaggcagcgtggagggccagtccggcaatgtccagttctccctctccgccccggtggcccagtatgccgccatgtacgccgtgtgccaggaaaaggatcaatacggcgatttacagaattacatctgtgacttggacaacaaggtacagctggatgtggccgccgtcagcagctatgcagacagtggggaacctgatcctgacgagacggccctgaagatcgtgaagctggaggaagggaccgagatccccctggaaggggctgtgttctctgtctatgacctggagggaaagaaagtcggttccttctccaccggcccggacgggaccgtgaccatccccctgaccctggagggccactataccataaccgaggagatcccgccccggtatcacctgctgccggaggagagcacccagcacgccgatgtggagtataacaagacagccaccctgaccttctggaacgccccctacggctccctgcgggtggagaagcggagcgacaccggcgacgccctctccggcgtcaccatccagatcaagcacatcgagactggcgagacccgcaccggccagacccgcaatggcgtcatcgtctttgacgagctggtccccggcggctgggaggtccgggagctggcgggtattgacggctgggtggcggatacggacacggtacagaccgtagccgtagtgtccggtgaggaatccaccgccaccattgtcaacaaggagctgcccggcctgcggatcattaaatatgagcggggcagcatggaactcatgcccggcgtctcctttgagatcttccgggacgctgagagcctgggcatcttccagacggaccagttcggtgagatcctgctgacagactgtgaacccggtacctaccgcgtggaggaacgggacaccggcggagacgaccatgtgctggacaccaccccccaggaagtggagctgaaggccggggacggcatcaaagagctggttttcttcaatgaccgcttaccgggcatccatctgataaaggtggacagcgccgacctgtcccagcccatcgccaacgcccgcttccgcatcgaggcggtagacggctcctgggggccggaggagtacaccacttcggaggatgggaccatcgacctgtccaagctccccgtgggcgcttatgtcgtgacggagctggagtgccccggctatgtggtggacgacgcccagcgcatcatccacctggacggcggcgaacaggcccaatttgtgttcaccaattccaagccgccctccctgcatctatacaaggagagcgcggacggcacgcccctgggcggcgtcacctaccggctggccaagatcgaggacggctcccgctatctggaccgcaccaccgggccggacggctctatctgctgggagggcctggagcctggcgtctactccctgcaagaggtgtccacagtgtcggaccacatcctggaccccacggagtaccatgtggagctgttccccggcaaggacgccaccatctgcctgcaaaatgacaagcgccccaatctgaccattcacaagagcgacgccgacaccggcgcgccggtccccggcacggtgtttctggtcaagggggcggacggccatagcgtggccgaagtaaccaccggaccggacggctccgccacagtggagaacctgctgcccggcgtctacgaggtctcggaaaagtcagtgccatccccctatctcccggacgccgccccccagctggtcacgctctactccaaccgggaccgggatgtgtattttgaaaaccacaagcggcccaccgtcaccatccagaaggaaaactccgtcacccatgaccccatccagtacgccgagttccacatcacctggtccagcaacaagacgcagaccggggagcagcgggacctgggcaccttccagacggatgaggcgggccagatcgtcctggagggcatcgaggacggctggctgaccatcgaagagagcaagcccgcccccggctaccagctcccggaggacccggttacggaggtctatgtcaagggcggtgaaaacaagaccgtcaccatctccaacatccccctatccgccctggtggtctacaagcaggacagcgtgaccggggcgggaatctccggctgccgcttccagctgaaatacctgggcggcgaggtcagcggcagcggcggcaccgtggtaggcacttatacgacttcggccaacggctcctttaccgtcacggggctcagaaagggctactacatctgcgaggagctggagagcgacagcggccacgtcattgacgccgcgccccagtccttctatatttccgggaaagaccaggatatcgtgaccctctatttctccaacgcgcccaagggggccgtactggtcaagaaggtatcggcggcggacaacacgccgctctctgatgtggagttcctggtgacaaaaccagacggcttcgtggtaggcaactccaacggcaaatttgtgacggactccaccggcaccttcctggtggagggggtggagcctgggaccacgctggtcattaaggagacccgtgccaagccgggctatctgctggacgatacgccccagaccgtccaggtcaaggagggccagaccgtcaccgtggagttccgcaaccagcccatggggaatctcatcatccacaagctgtccagcaaggacaagactccgctggagggagtgcagttcaagatcacctatgcgaacggctcctacctgccggatgagggcggcaagctgtcctccaatggactgtactggaccaatacggagggccagatcgtcctctccggcatcaccggcacagtggttgtgactgaggtggagagcatccccggatataccatcgacccggatacccagagccagaccgtggtggtcaacccggacgatacccagcagctctacttctataacgcgccgactggcggtgtggagctcatcaaagtcaatgacgcagacaggacagagcgcatccccaacaccacctttgagattcggcgggtatcggatgacactctggtggacaccgtgaccaccgggcggagcggaaaggtgtatctacccctggaaagcggcgattactacgccgttgaaaccgaggccgcggatggattcaagctggacgatacgcccatctattttaccgtcaaggacggcgagaccacccgcaagactgtgaccaacgcgcccttctccggcatcctgctgcacaaggtctccaccgtggacggcgagggcatccccggcgtgtcattcatcctgtacgacagcggccataaccccatcggccagtacaccagcgacaacagagggtatgtctatatcgacgacctcacggagagcggccgctactacctgcgggagctggagaatgagggctatatcccggacacccaactccgcacggtctatgttaaagcgggcgaaaccacggaagtgacctgggagaacacccccatcacaggccagatccaaatcaccaagcggtccgccgactacaaccccaccaccggcctgcccgctgggacaccgctggagggggccatattcgagatttacgacaaatcgggcaatctggtggacaccattcggagtaacagccggggtctggccgtgtccaagcagctccccctctcccgctataccatccgggaggtcaaggccccggagcattacggtgtcaacgaaaccgaactgaccgcctatctggaatacgagggccagatcgtgcgctttgaagtgacaaacaagagcctgactaccggcgtgtccatcacaaaaaccggccccaaggagatcatgggcggccagccggtgcgctacaccttctccggcatcgccaatacttccaatgtccggctggacagtttctattggagggataccatccccgctcaggtacggctggacactgtgatcaccggaacctataacttccccggcacctataagatcacctatcgtgtgaacggcggggagtatcgcaccctggcggataatctgagtaccagccagacctataccctggccgcatcccccgcagccctgggccttgccgccaatgagcgtgtgaccgagattatgttcgtgtttggccaagcccccgcaggttttgcccaggtggaaactccctacttaaactgtaccgctgtggccaacctgcccgccaactccagctttgtcaatatcgcggacgtgggcggcgtgtacaacgggacatgggtgcaggccatcagccggtgggtgaccacggtctatggcaagcctgatccgctcccccgcaccggctattgatccgtactctgggcgtctgttctgaagagcggacgcccttccctatatcttaaaaaagtaaaggagaactgaactatgctgaagatcactgccatcggtaacctgaccaacgacgtggagctgaaggtaaacgagaccaccggaaagccctacgccatcctgcgtatcgcctcggaccgccgctaccgggaccgggatggcaaccggctcacggactttatctccatcaaggtgcgcggtcctctggcggagcgctgtgcggagttcgcctggaagggctgcaagctggccgcggtgggcgactttgagaccatcagcttcgcggatgaccccgaccgccagcccggcttcctgatcaaagccaccgaggtggaatttctctcccccagacgggtggaggaagccgccatggccgccggggagccggacgacgctgatgccgcctaatgaagaacaccgggatcatttacagcagcacggagcgcacgcccatcatgctgccggagctggccgggctgctcccgcctttgagcgaggagcagctcggcgcactggagacggacctcctgaaaaatgggtgctatacctccatcatcgtcaatgaagatctggtcgtcattgacgggcataaccgaaaatccctgtgcgacaagcacggcctgccctatcaaatgcttgtattcgcctttgacgatctgctggaggccaagcaatgggcgctggatacccagaagggccgccgcaacctggacaagtgggagttgggcaagatcgccctgaaactcaagcctgagatcgaagccaaggccaaggccaatatgtctgccggagggcaggcataccacccatccgaggaaggttcggcaacattgccgaaccttcctcctgttgatacccgcaaagaactggcggactccgttggcctgggtgagcgcaccatgggcaaggtgatgcagatcgacgagcacgcccccgcagcggtcaaagaggcgctggacaagaaggagctgtccatccaccagggctaccagatcaccaagcaagtggagaacctgccggaggagcagcgggagcaggcggccctggaggcggtggagctggccaaggcgaaaaaggagatccaggaaaaggacgcggagattgaccgcgaggggaagatcgccggggtcttctgcaaggcgtatgaaaaggcggtgctgctggaccccacagaggaaaatgtccagatctgggctaaatgcacccgcatgaccagggacgagatggaagatacggtgaaagaatcccgtgaattggcggaggtgtttcggaccattgccgacctcatggagcgcttcctgccggatagggggacgctatgacggaaatgagtgtccgccagtggcaggagcggtttcgtgccggggatttttcctcaaaggatcgtgctgttcaatgtgaggccgggtggtatgactggttctgtcaggatgacgccctggccggacggctccagaaattgagcaaggtggttatggggatcaccgacccctatatcctggaccactactatgtctggttcaagaacaactgcccgctgtccggcccgctctatgatgacatacggtttgaaccgctgcatggcgaccgcagcgggaagtattttgtggtcatccgggacagtccccatgaggcccataagtggacgctttacacagagcgccatggatttgagcagccggaattcacctgtggaaacgtgcgggatatgctccgccatatcaattccatggccccagagtcctggcgtggtaatccgccgcccgaaaaagcgatgcatcctcctcaaaagaagcgaaaggaggcagagcgatgaaccgggaaaacacgggcgccaagccgactgctccgcccagactgccgccagaggcggagcaggagatcctggaggcgttgttcgagggaatggagatccattccagcgagatcgccgcgatcctgaaaaagcatggcgtgtgcggggatgtggaggccctccaagacagctaccgcaagcgcctgggccagcggctcatggccagtctccgagacgagggcggcaagcgtgaagtgctggccaacggaaaaggcagctatgtagtgctggagggctgcggcgacaggcggcagctcaagcagatccgccgccgtatccagaaccagatgaaaggactggatctctcggcgcggaaagtgtccggcaggctgacggttctggaacggctggcccgcaagtggagaagggctggttgagatggatgccaagacattctatgagcagatcgctccaaaactggacccaggtggcttcaagctgtacttcacggccaagaggatgactggctttgatctatatgggcagttcccttatgaggatgcccgcgggatgttcgaaatgatgaacggccaccagctcatgcgctatctgctggcggatcagttccatgcggttcggtgggagatcgtgcctggaacctgctatgaacgggctgtccttctccccctcgaccgcaccacgccggcatatcgggcattcgagcagaagctgtacacagcggtcctgcacgactaccatctgaatcctcagaaacaacatgatcggaaggagcacagtaccagatgaaagatgtaattgtgatcggcgtggatcatggctacgcagccatgaaaactgtacacttttcgttccccactggattggtagagtacgaacatgagccgtacacccagaaagacgtactggagtacaacggcagatattatgtggtgggcagcggccgccagccgcttcagagggataagacccagacggaggactactatctgctcaccctggcagccatcgccaaggaactggagcatcggggtgcggagcacaccgccagcgtccacctggccgcgggcctgcccctgaccagctttggccgggacaagaagtccttccgttcatacctgtatcgggatggaagcgctatcccttttcgctacgaggggcaggactacaccgtcaccatccaggaggtgtccctgtttccccagggctatgccgccgtactgacccagacggaactgctggacgagccgtccgtcattgtggcggacattggcggctggacggtggatctgatgcggctggataaccgcatccccaacgccgcttcctgccggagcctggaacttggcatgatccgctgcattgatgagatcagcgaacaggtgcgccggttgttcgggctgtccatgacgaccgctcagatcgaaagcgccctgcggggcagttccggcgggatggacgagcggatcagagcggtcatccacacccaggcgggcaagtacgcccgaaacctgctctcggcagtcacagagagcggcctggacatccgagccatgcccgccattttcctgggcggcggagcggcgctcttaaaacgccacctttcggccacagacggcctgtgccgcccgcttatcctggacgacgtatccctgaacgccaaagggtatgagcgccttgtggggcagatgtcgcggggtgtcggccatggcggataagcggcggctcaacctttctttttctctgacatcgccccagcagcgggaagcttggcgcatcctgagttccatcccagtggggcagcggacagacaccgtgtgcaggatggtctgtaaggcccatgaacaggacgccctgctgtccgccatccgggggctgatccgggaagaactgcgccatttggatctgacaacagaaaaaagccggcaggcacaggccggggacatggatgagaatgtcctcggctttcttcttgccctgcagcaggaaggagatgagatcacctgatacgctattttgatatgttcgccgggatcggcggcttccgggccggactggaccgagctggaggtttccagtgcgtcggccattgcgagatcgacaagtacgccgacgccagctaccgcgccatccacgacatccgagaggaggaacgatactatcccgacgccagaaaaatcgacccaaacgacctgcccggcttcgacctcctgtgcgggggattcccctgccaggcattttcaaatgctggccgaagaaagggatttgaagatgccagaggcactctcttctttgagattgcccgcctggctcaagccagacgacctgcgtatcttctgcttgagaacgttccaggactgcttacgcatgaccagggccggacgttttctgccatcctcgccacgcttaatgacctggggtaccgcgtggaatggatggtgcttaacagcgcggatttccgtgtcccccaggtccgaaagcgggtgttcattgtcggatatcttgatccccgatgcgccggaaaaatacttcctgtcttcggaacagacggaaaagctcttatacaagtcctcggcgggccgcagggatcgagagtctatgaccccagagggaccgcctgtacacagactgccggaggtggaggaaaaggagtaaagaccgggctgtatctgatggagccggacacagcacgatcctgttttgtggatctgtgtatcggcaggccgacaccgaccgagaacgccaggtgccttaccgcacgatacagccaaactacactctgcaaccaccgcggagaacgctctggggtcctgctgatcaaagaggcaaccaaacgcggctacaaggaagcagcgataggtgatactgtcgatctggggtatgcgggcagcaacacacgccgtgggcgtgtgggccacgatatcgcacacaccctggagaccagctgcatccagggaatcgtggagcgcggcgggcgcatccgccgcctgatgccccgtgaaagccttcggctccagggatttgcggaagagcagatcgacaagatcctggcattcacctcagatgcccaggcctataagcaggccggaaacagtgtcaccgttacggtgatcgaagccattggccgccgtatcctggcggtggatgaagaaccgcggaagatgggtgatgcggcatgaccggcctgaaagaccagtgcttcggcgtagaagtggagatgaccggtatcacccgtaagcaggccgctcaagcgctggcggactactttgggaccataccgaaagccaaaggcggcgtctatgatacctggaaagtgaaggaccccacgggcaaggagtggaagctggtcagcgacgccagcattattggggagcagtggaccggaacagagtatctggaaaatgacatcaaagattttcgtgtggagctggtcacccccaagctgacctatccagaactccccaaactccaggagtgtatgcggcgcctaaagcagatcggcgccaaggtcaatgactcctgtggtatccacgttcatgtagacgccgccaaccacaaccggcagagtctgaagaacctcatcagcatcatgtactccaaagaggatcttctgtttaaagccttgcaggtaaatgaggtgcgggccatccgtttttgtaaaaaggtacgagaacctatgttgcggaaggccagggccctatctgcagaggagacaccagatctgactcagttggagcggatctggtatgagggagatgttcacaaaacggatcattacaattggacacgttattacgcgcttaacctccattcggttttttaccggggtacggtggagtggcggtgcttcaactccaccctgaaccccaatctggccaccgcctatgtgaacctctgtctcgccatgtccgcccaggccatcgcccagcgcagcaccatcatgcgcaagacccgcagcgataatgagctgtttaccttccgggtgtggctggtgcgcctgggcctcaatggcgatgagttcagggagacccgcgatctgctgttggcgcatctggatggagatcgggcctggcgcttcgacaaggacagctatgaagtcaatcgaaacaagaagaaaaaacaccgtgaggcggagaggtgaccatgaagatacgaattgatgacactatttatgaggggactggggcggagatcctggaacagctccggctggccgcctttgaccccactgagttcccggacacggagagctatctctggcagctccgcagcaacttcatccgcatgacggaccgggactgtgtcctgccggagcacggtctggaggagcaggcacgggtactgtttggggaactggcgaaaattggtgcgctggaggtgctggaaaatggctgagggaaagctgtacttcgcctatgggagcaatatcaacctggatcagatggcccagcgctgcccagacgcccaggtggtgggaccagtcacattggagaattatgaacttctgttccgcggcaatttgcggggcgccggagtggccaccatcgctcccagggaggggagcacagtacacggcctgctgtggaacatcacgccagagtgtgagcgctccctggattattatgagggttaccctcacctgtatgggaaggagccggtaacggttcatggacatgatgggcaggagcacacggttatggcctatgtgatgacggagctgtgcaaggaaccatccattccctcctttgattattacaacggcatcctggagggctaccggcagaacggcctgcccacacagccactcaagcaggcatgggagcactgcgtggaggaggttccccgggagacagagcggatcaaccgcagcgcctgcggccagctctcgcccagacggaagaaagaccgtgggcgataaacttaaaatcagtcaggaggcagaacctatgccaaacaaaagcatttccctgtctggggaagtacatatcagcacagaacaggtttataccaccgtggacgcactggaggcgctgaaggccattggtctggcctatggcctctacagccgcgcggaagaactccgcgggcagcgtgtccacctgacaggtgacgagggacatactgctctggtggtgcaggaggatttcagttgtcacgggagtccatgctgggagacagttcggactttgaccgaggacccggcagagatccagcagtacatggcctttcgggatgtgcttcgtatcgtccagcagcgggatcgggaggaacggctgcccgcgaaacagcggacaggcgacagcttccctgagcatccacccaggcaaggcggaagatcccgtgagcgatgaaccgcaccagttcttgaccagcggtgagcttgatgtcaacgatttgtttacgaccaaattacagaagggagcctgtgcggcccatctgcgcggagtgtttaccaatacgggcgaagtcaaaaccaccctgttaaagaagaatgagaaactggcctccccagcgttccaggcagaattgagcaccttactgggagcccttcggggagacaacggaccgctgcgggacctcccctctatgcaggcatattgcagcgcgcatccccaggcgctcatgcgcggcagacaaaccttttacgcattccgaatcgacgctggccaataccgatattatctacgatttttcccacagcgggaactccataaattttttatcttttgctaccagacagaccggctgcgggaagatctccccgcgccggattttcattccctgtacaggaaaagaaaccataaaaagaaagcggaaagaggtgaaagatcatgaaggttttgattgtggagcccatgaaaccctgctatgtgcgggaggtcagcgggctgaaagatatgcaggaggtcgtgggcggagatattgaagccacatacccatttgaggatctggtcgccgttgtattcaatgccaacggaaaggggctcggcctgcccttcaaccgccctctgatggacaaatccggcctgccctatgatattgtctgcgggacgttcttcctcgccgggctgggcgcagaggactttgtttccctgacagaagaacagatccggcggtacaagaagctatatgacaatgtcatggtcattaccgcggtgaaggaaccgcttcaaggcacaaaaactgaacaaaagaagaaacgagggaacgcgcatgaaagataagcatattctgaattcagagttaactatgagtttacgacaaagattcgcccccaacaggtagccttaagacggctccagcctaactaataaaaaactttttgcaaatacttgtggagactctatatcctacgaaaatgaaactttgtctggaacggtcattactaaggtaaattatgttggcaaatatattttcactgtacaatatatttattttacacaaattttgctatttacctctttacaagctttgtttgatatattaaaattatagttggaaagagtagagcgattatttaggaggtaatagaatgatattgctggttgttgatactcaaaatttaattatgaataatgatttatttgaatttcagacttttgtatatcgtattaaaacactaatcaaagaagcacgcaataatgatatagaagttatttatgttagacatgatgatggggttggagagaaattaactaaaggtgcattaggctatgaaatatacgaagaatttcagccaatgccaaatgagcgtatttttgataaaaatgtaaacagtgcttttagagatacggggttgttggattacctacatgaaaaagatgaagatacaattattattgttgggctacaaacagattactgcatagatgcaacagtgaaatgtggttttgagcatgggcttaaaatgattgttccagcaaatacaaacagtacgcttgataatgcgcatatgacagcggaaaattcttatagatattataatgagttcatgtggaatggaagatacgcagaatgtatttcatttgaaaaaacccttgaattgatgaatagataaatttcagtttgtcgagttgtttcaaacctttctaaccccttttagttaagagacatcgtttacaaaaactctataggagttttgtaatcaggtaatggttaatacctcgtggacgaataaaaaccctgtaggagtgattgttatgaaaaaaattatctcgcttttcatcgcactttgcatagctttaagcctttctgtcccagtgtttgcggcaacttccgactctcccatcactattagttctgaagatgtaataacccattctactcctatcccagctcccacaataacactgcgaaagtctgccccacaagttactgcactggagctttatgactatgggtggatagaaggaactgatcattggggagtaattattaaagttactggttatggaaacgataacaggaaagcattttggaacgatacgcagcttacctccaacgataaaacattgcatggatattggcttggtccagataataaaaccgctgttgcttttgcatatctctatgattgtggccccattacagagcctggcacatatacgttcaaaaccacttatgtttccaccaactggccgtatacggaaaagtccatttcccttgactttacttttgaggctaccgacaacacatgataaaagatattgttacatctctgccgctcactctttcctctccccatatgacgaaaaactctactccaagttctaaatcttctcattcttttcatgtatacatgttgagtaaagattgtatctattccggtggtggctacggtggtcaaagtgtaaatgttatgtacaccattgattccaccgcggaagatccaattgttaagatttttggaacatctatgtctggtagttatgaagaagtcgtgcatattaatgatattgatccgacaaatgcaacctatcctgaattatgtgctcttcttgcgcatcaacagagaataggagcctatacctctggcgcaaataagcttctaattccaactcccttaaatgttgatcctggtgattactccaaacggatggactatataagtctcatacgcgatagtttgagtaattcaaattatgtcgatttgacaaattctactcaaaagcttcttgacttctttgagaggtatctaagtaaaaatttagagaagccagaaaaattttctatacttatgcaaggtaattatattgaacgtttccgtatagaaaagtattgatgaatcaaggggtgccttataataaggcaccccttagttttcattcaataataaattattttatcaagaagttgtttacacaaagataatccagattttccttgccagcaataagcaacttccagtctattgcacgatttctggtcgggaagtagtactgtaaggacgtggcggtgtgcgatatgcataacacattcggatgaaagtttacggaaactaatacaaacgccgtacgattttcggcagcggagaaaatcattccaggatgctttcgactgattgttgataattcccattatctagctaatcactcctaaaagcccatcttaacacactcataacacctttacagctctccccaggccgcaagtgcggaagaactatcagaaaaatattgatctcagatttagaaaaattacagaaaggtgggctgtgaaaatatcttcaatagctccggataaggcatagggcagcgtttgctgccctatcatttttgcaacgggaggtcgggaaaacagcttctggcagaaggccacctgaacacccaggaattgttggtatcgctgggtttgtgtctgctttttcgtggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgacctttttcgttgcgtatggtgatagcttttcgccgcccaaacgggtattgttgtggtcggaaacccaccccaaaatcagtaaggaggacgctctgatgaaaaaaatcgaaacccatccctcgccggaaaaactgcttcgacaggtcaccgaggaggcggtcaatgccctggccctgggcgggccggataagatcggggacgaagcccccatggaggtaggcgtgatgctgatcgccaaagcctggggcctgccccaggagagcctccaggccagcctggacctgctcgcaaaggaacggcagctccttcgcagcgagagcggcgaggacgccctgcccgacagcgaactgctggagccctacgacggcagaatgatcgtcgagctgctctggggcctgtttgagacggcaatcaagctggaggacgcccaggaccgggcggcaatgcacaagctggccctgctcatggcggagagtctgagcctggatagttggatcgcagagtgcgggccatctaaaatctgagacagaagcatacgggaggggctgtcccaaggggcggcccctcgcctgtctgtaaaaaggagatgaagcagtaatcaatcagaaatacgaactgaccgatatcgcccatgagaaatatccctttctccaccgcatccgggccctgcgggatatcgggaagaaggtaaaggccggggagctgggcggctttgtagagagcgagcgcaacctgtcctttgaggtgggagatgacgcctggatcttcgacgacgccattgcgtgtaacgatgcctatgtggacaagggctcgtccctgtttggagagtccgtcgcctgcggaaacgcctatgtttcccagaactctgccctgagcgcccatgcccgcgcggaggacgacgcctatatccgggggagtaatctctgcggccacgccagagtatccgactgcgggatggtgctggactcgccggacacaggccgtgcacccattctgtccggtaccagtgctgtgtatggcagggtatgcggcgatgtgcatttaaccgataccgcgttgatcatcagtggtgaggagatctgcaacgattccctggacactctggtgatggatggaaaggggcgttccgtcatccgtgacccatccagggacgagttggcgccccaggagccggagccgcagcaaaaaggacacaaggaacgggggcagagcagatgagtaattttttcgagcaggagctccgcaagctgtttgcagacgggactatcatccgtgatccggttttcgtgggtcgggcctgcctgggcagcttagacagaaaccgtcaggtgagggctgaatttgttacactgggccatgcggaccactatgcggcgctccgtctgacgctgttggacaacaatcaaggcgtggtagacaagctgatccttcggttcaaagatatctgggggaaaaagaagatccctaacaatccctacctgcgggatggtgttgctccacatatttgggtggatggcgaccgaatcgattggtatgcctaccatccctcccaggaggactaccagcagctcaggcaaatagccagcgactatgtggagaccttccgtattcaagtcctgacgaagaaccatggcaccaggctggtctacatctgcgcaccgctccgaggcgaactggaaaagaacatcgccttcgcaaaggagaaagcgcaggaggtgttccaggccggggatatcccgatctgtccccacctcatgttcccgccctttgcagacccggatgaccccacccaggaccaggcggcgcgggagatgggcctgcggctggtggagcactgccagcaggtcaatgtgtacggtactgtgcgtacaccggggatgctggcggagatccgcagggcggaggaacttaacatcccggtcaaggccgaccagccagggcttaaaaagacaaaggaccgtcccaggcgcggccagaccagataggaggtaaaatggcagaaatcaagatagtcaccatcgacgaactgcgtcagatgaacgatcaggagggcctcatcctccagggctgcggcggggatctccaggagtgggtggatggtatcaatgagctgtttgcccaggctggtatcctacaggccggcagcgcatggaaagccaaggctgtgaggagcttccagtacgatggcctgaccaacctgctgtttccctttgagggtgttttgatggatgtgggaaagctggccatgtggcggctccagacgcgcgaacagtttggcggaacctggctcagcgactatgttcccaaccggctgggcggttttatccaggagcagcggccggcaaaacccaaaatggcgctggcgggccacgacggaaatatcttcggcatcctgggccgggcctcccggctgctgaaacaggccgggcagagcaaacaggccgatgagatgtttcagcgggtcaccagctccggcagctataatgaagcattgtgtatcatcagcgagtatctggagacggagctctccaccgcgccaaaacctcaaaaatctgttcaaaagaaaggcagggatgcccatgaacgataagtgggagattctccacggcgacgcgctgaagctgctgggcggctttgcccccggcaccttcgatgcggtcatcaccgacccgccttacgcctctggaggccgtacccaggcagagaagaacaagtccacggccaagaagtattccagcatgggggatcacgcgcccccgcccttcgacggggacgccaaggaccagcggtcctggacccgctgggcggcggagtggcttggggatgccagaaagatctgcaagcccggcgcgccggtgtgtatgttcatcgactggcggcagctccccgcggccaccgacgccctccagtgggcgggctggatctggcggggcaccgctgtgtgggacaagggcaacagccgcccccagaagggccgcttccgccagcaggcggagtacatcgtctggggttccaacggggatatgcccatcaaccgccccgtcccctgcctgcccggtgtgttcaagtacggcaatccccagaaccgcatccacctgaccgagaagcccctcccgctcatgcgggacgtggtgaagatcaccgagccgggcggccatatcctggaccccttcgccggcagcggcaccacaatcctggccgccgtgctggagggctacaccgccaccggcatcgaggtcaccggcgagtatgccagacgggccagggagcggattgagcaggagctgcgccaggcggcgtgaacatggccgtcaacgctctttttccctcctacgcagaactgctgaggccgctgtcctggatggagcggtcagagtgacctccggcagctccaccgcaagcccggcagcgatgcaaagctgccgaacggaggagaggacaatatcccatgtcagctcagaggcgtagctgtacctcgcacggtaagtatcccagagcttcctcatgtggggatcgtccgcaagctcccgcagaacatcctccgcctcagacagcagtcggagcgtcccacgcctcctggccgtcgcgcagagcgcgtctgtcagaacctgcgccgtcagggtgccgccatagagctgacataaaatgtggagatcataaaagtcccgcatacgggtgttggttgtggcgcgggaaatgaccgtttccagcttctcggccaacacggtctccaggctataggccagtatctcgatggcccgctcctcgaacatcagatgaaaacggtagagaacttctctcggcgtgattgcgtcgccagtagaaatatcaatcttaaatggagtgcgcaccccatcgaacatcgtctccatggacacccgcacaccggggtactccgcctcgtccataatctcggagacgctttttaaggaaaagaaaacgccatccttgaccgggacggatatgatctcggagatcatatcgctgatatggtcgacatctacggcggcaccccggaccgtcgcgtcaatgtccatggtggagcgtgtatccagcccaaccatggccgcgaccagcatcccgcccttcaagataaaattctccctgaactgtgagagcgagacgcgctccagaaagcgctccatcatgtaattccgcatgagaagctgcgcgtctgccgcattttttcgggcgagattgttgatcaggtcttttaactgtctggatgttttaatcataacaggacctccaaatactgtctcaggatgttctctacatggaacgctccggcatagtgcatcaggcggcgcagatccctgtctctccggccggcgtaccgcctcagtgtatcccggaggacctggacatccatgccgctccggctgcgtaccacatcgcagacggtgcgctccaggtcataaaccgccaccggatttccaaatggtgtgtttgtttgcgacaggcccaggccgtgcagctccgccttgatgcggtacaccttcacaccgtcaccctttaagcggtgcggattgtatccgctttttacagtcaccgtataggcaagcggctcccggtcggtcaggtcgtggaggaaaagagcggtatcatgggaaaacacggcctgcggacagcgcagatggagcaggtacatcccatccttccaggcatccggggcaagatagagcccgtggcctacacgctccaagtctcgttcccgcacataatttccaagcacaggcctggtgatccctgcagcaacggcatccgcagtccgcagcacaccgtttccgccgcgaaccagagcatccagaacatcgaatgcaggcatagaacgccctcctttcgtgctcatataataacttatataggcacaaaagtaaacaaggcaaacagagatgtttgagaaaaagctggaggcgggccggcatattctgaccgggaagcccatcccactcatgcgggatggggaggagatcagcggtgggtatgcccgctgggccagggctgggcggcatagcagctcccgcccggaagggctgttcgtctattccggccactgtgtggggaatgggtatggccttcttgacggcgtccggatatactgtaggcgccacaactggagaaggagtgtaaaaatggaagaacagaaattgatccaaatgatccggtttgaccatgacctcgtcgtattcatcgagggatcggatgaccagcagcggcaagtgaacatctatgggtatgccatgcatcaagcagtaaacgtatgggactttgttgagtggctgtgtacgcgcaaaatgcgggcggtatttgccggaaatccctacgcattccctgatattgtgaattggctgggcgggaagctctatgcgatccgggccaactatatcctgacacacaggggcctgcttcttccctggaatgcggtggatggcggaaccgtctggaaaccgcggtattgaataccttttttctgatgacggcaaatgcagccgctatgtagcgggcttttggggcgacctgtccgatgtgaaggatattcacggccagcccctgtgtgtggggaatatggtgacgatgctccacagtggagagccctatgaacagatgatcatcctgaaagggaaaatcccagctctcacaggagcacctgaaccgtcatggtgcggttttccagcccccatttacagaggcgggcatcatgaccgcccaaagatactcctacccgataatagaacgccaatcctgcctcacagcctactatcccgctcagaaacgggccagggcgcctgccaagcagcctcaaaaaacagagggccaaactcggtgagggctgtccggcccggccactccgaggccgtgctccagactgcgggtggaaagggctgtttggggatagtccggcctgttcgggaataggaatcgctttcccgcccggtatgtggtattgtgtagctgtggaagcagcccagtataatacagattgaaacggagggaactgtatgggagtccaacgggcgatcaatggacagctcatcacatgggaagtcatcgtttacggcttcctcggtatggagcaggtggcggcacgctacaaagacccttggaaagcggcggtctattgctgtgagcacaactgcgccgaagtcaagatggccctttccgaaccggatgagccgttaccgacaaacgactaaccgcagcggccgcggcatcggctggatgccgcggccaactgtacaaggccgactttaaaatcctgtttacattctataaactatcgggtatcatggaaagagaaccgcacgaggaggcaggacaatggaacagcgatatgataaggaaaccgggcttcccgtagatcgcgcctatctggaatgcggccttcccccttatttgcagaggtctctggatacgatgaagcgggcctgggaggcggaggacaacggcgccaacgacctccacttcgacgcgtattattgtgagctccaggccgacatcaactccgcggaagtggagggagaaatcagctccgagcaggcgtggtacctgcgggaaacctatttgcgcattcagcgcggagtaatctgatatgatagactttacgaatcttccaagacggaacaagacctatggcggcgccaatggcagcaagcgctctgtcatatatcaagatgagcagtatatgctgaagtttccgccgcatccgtccaggaacagggacatgagctatgccaatagctgtctctccgagtatttgggctgccacatctttgccctggcgggcattccagtacaggaaactctgccggggacctatacctatcacggaaaagaaaagattgtagtggcgtgtaaggattttacatccccgggtgttgtcctgcaggactttgcctcaatgaaaaaccaggtgattgattcggagcggaacggatacgggacagagctggacgatattctgttctccatccatgagcagccggccatagatcccaaggagctggaagaacggttttgggatatgttcattgtagacgccctgatcggcaattgggatcgacacaatggaaactggggcgtcctctatgatactgtgcatgatatggtagccttggctccggtattcgactgcggcagctgcctgtatccgcagttggacgaggggaaaatgcaggccgtactcagtgatccacgggaaatggacttccgggtatatgagatccccctgtctggaatcaagcagcaggacaaaaaaatccggtattttgattttctgtcctctctggaatacgagggctgcaacgcggcgttgaagcgaatcggaccaaggttggatatggagcaaatctgccgtctgattgatgagacgccctgcctttcaggactccagaggaggttctacaaagagattctggcgctccgaaaggaacggatcatcgactactcgctgcagaggcttcaagagcgtgagcggagtatgcttccaggccatacaaagaaaccgtccagagatactgagcgttaaaatggctggagctgggtgttacctgtagcacccgaatcgccacaatttatcgtaagatttgggcccagggtgtgcaacagcgcaccctgggccttttgtctgcgtcaggaaatagggcaggaacggacgggaaacagccaagctgcgaccggatgggaatcacgcctcccgcccttttttgtggaaaagcggtccgtccctcggaatttcaatcaatcataccgctgaaggagcagccccgccctggcggggctgggagcctcgccgcctctggcggtgaggccgcaagcatagcgcaaagatatcttttgcgcgcttgcaggggttgaacccctgtcccccatgccgccttcgggcggaaaatcagcggccacaggccggagaaggagtgacgatgccaaagagctacgagatatgcctgagattgtccgcggaagaaaaggaacggctggagcacagtgcccgcacctgcggtctctccaagacagcctatctccgccgccttattttggggaaggaggtcaaggcgctcccctcacaggagatcaaggccctgcgcaccgaggtgcataaaatcggcgtcaacatcaaccagattgcccgcagcgtcaacgccggaattgccaaggcggaggacgccaggcgggggctgtacctgctggaacaggtctatgagctcatgtatgaggtagcaaaaaagtaatggccatcaccaagatcctggcccggaagggccgcctggacgtgggcatccgctatgtgctcaacggggataagacccaggagcagatccttacagcccgtctcaactgtgaccctggccatgagtgccggcagatgctggagaccaagcgggccgtgggcaaggagggcggcgtacagtattaccacctcattcagtcctttcagcccggagaggtcaccccggagttggcgctggagatcgcgcgggagtttgcggaggagcacctgcccggctaccagacggtcatcggcatccatgtagacaaagagcacatccacgcccacatcctctttaactcggtcaacgcagataccggcgaaaagtaccacagcaatgcccagagctactaccggcagatccgggtcatatcagatcgcctgtgccgggagcgcggcctgtccgttctcctccaggggaagcccacccaggcggtcagctacattgagtggctgcgccggtccaggggccagcccaccttccgctccatgctggaggaggatctgcgcaccgccatagcggacgccaacgacctgggccacttcttcctgctcatggagcacatgggctacgaaatcagccacgggaaccgcttgggcttccgtctgcggggacaggagcgcttcatgatccccggcaggaaaaatccactgttcaccgaggacggcatccgggccgccatccaaggaaatctggctgccattgaggctggacggcggcctgccgtccagctccggccgcagtaccgcccctaccagaagtaccccaggtacaccggctttttggccctgtatgtccactatctctatctactggggaagatcggcaagcggcagtacccaccccgcatgacgccccagctctggcaggaggtcatgcgctttgagcagtaccgggaacagtttgccttcctccgggacaacggcatcacgacccggacggacatggcggccttcaccgcccgcacagaggagacgctggccaacctgatgaagcagcgcaccgtcctcaatgtgcggaggaagcggcgccgggcgctttacaccgctttggcggatgcggaggccctggcccctgtcaaagagctctatgaggccggactgtccggcatggagacggagtttgcccagtacatggacgctgtggccgccctggagcagtgcggcgtccccagagaagggctgattcaggaaaaggcggagctctatgatcggctggcagagctcaaccggcagatccgggcggagcggaggaagttggccctgtgccggaagacccaaaacagcctgccccggatggagcaggaaatcgacaaagcagaagcgcgtgaaagcgaggtgagaaccaatgaacataggaggcggtgaggcggccgaccaaatggtgcgtatgctgctgtccgggacggaggtagtcattcggctgtccggctcggccctgaagaacctgctggcccttaccctggcccttgcccggaaccataagaagctctccgggaaagtcaacctggggaagatgctgcgggagacacgggatctccggcagttctccatgaccccggagcagtacaaggaatttcagcaccgggctagaaagcagaagctgttgttcgccaccgtccgggatcgggatggccgggggaagctgatcgacgtgatcctgccggtgactgaactggatcgggccaaccagatcttccagcgtatgctgtaccaggaaccggaccggcagccggaagcacccaccccagagagggagcggacgaaggagcgtaccagccccgaaaagggcccgcaagagtgccagaggcaccccaagacccccacggcacggcaggacccgcagacgcccacacagggccgccagagcggccagacggccccacatcaggcagatctgccaaaaaaagagtctcggtcgggacgcggctcgcgcgatacaagaaccagctcctctaccccccaaggccaagaaactatgactgaacgcccctcagtggagggacggctcagggcttaccgggcgcagctggagcggagctccgtcccggccaaagagaaaacaaaaacaaaatccaggcccaagacgagataatggcgcgtttaaaacaggcattccactcctctggggtgtgccggtctatgaccggcgcaccccagattttttgcgttttcccggaggtgaacgccactgaaacagccatcccaagcaaacaggcttcttgtctgcctgttcttttacattcccgtggtctgggcggcgctgctcattgcccaatcgctggagagcggccagggcacggctggcggactgccggccctgatcgccaacctgaccgccgcgctccagaatcctctgaaggtgcggtggacggacaagagcctcctctccatcctaagctgtaccggcatctatatcatggccctcgccctgtgggacgcggagcagggccggaggcgtgagggggcggagtacggctccgccgcctgggcctcgccccggcaggtcaacgccatgttcgcccagaaggagaacaagatcctgacccgcaatgtccgcctggggctggatacccacaagcaccgccgatccctgaatgtgctggttatcggcggcagcggcgcggccaagacccggagctatgtgaaacccaacatcctggaggccaataccaactatgtggtcaccgacccgaagcaggaggtgctcactgccactggcggctggctgaagcagaacgggtacgagatccgggtgctcaatctggtcaacctggagcagagcgacggctacaaccccttccgctatctgcgggatgagaaggacgctctcaagctggtgaacaatctcatccaggccaccaccccgaaaggcagtcatgagtccgacccattctggaccaaggccgagacggcgctcctccaggccatcatcctcatgctgttccaggaggctccggagtatgaacagaacttctccatggtcatgcgggtactggaatacgccgaggtgaaggaggaggacgaggagtatgtctcgcccctggacctgctcttccaggccatagaacaggatcgaccggacagcgtagcggtgcggcaatacaaggtctttaagatggccgcgggtgttgtatgctctaaaagacttcttaatcaagcggttgggaagtctcttagaacacacaacctaaaaccgaagaaaggagcgcaagttatgagaaaaaatgagaaaatcacagctctgtacgaacgactgagccgtgatgactttggcaaagatgatgaccaacagcgtgagagcaattccatttccaatcaaaaggctatgttggaggagttcgccgcacggcagggctttacaaacattgtccatttcacggacgatggcattagcggtacttgctttgaccgtcccggatttctggcaatgatgaaagaggttgaagccgggaatgtggagtacctgtgtatcaaggacatgagccgcatgggtcgtgactatctgaaagtcggtcagattatggaaatcctgcgtcagcgtggcgttcgccttatcgccatcaatgacggcgtggacagtgccagaggggacgatgattttacccctttccgcaacattatgaacgagtattacagttagtaaaaatattctatgataaagaaaaaatggataaaaacatcgaaaaaacaacgataaaaatacaataaatcgaatggtggagcatggcggccgggagattttgtcgaaaggtgctatgagcaccacaccgcatacttctgaggtgaaaatcatgttatccactattattcccctcaaagaccttatcgcaaattgagaaaattaagagaaaagagaactatttgtctgaaagcacatatgcgagattgacgctgctccggggaacaatccggccaaacaactttatcattgaaaaggtcacgatccagttgaaagggtcgtgccctttttttgcgcccaaacgacaggaggcagaacatgaacttcgattattactatggcgacgagagcaatcaatttgctttctaccgtattccccggcagctcattaccggggaagcgttcaaaaagttgtccacagacgcaaaactcttgtacggcctcctgctggaccgcatgggcctgtccgccaaaaacggctggtatgacgatatggggcgtgtgttcatctactatactctggatgaaatacaagaggacctgaactgcggccatgaaaaggcagtccggctcctggcagagctggacaccggcaagaaaggcttcggcctcattgagcgggtcaagcaggggcagggccgccccactaagctctatgtcaaacgcttcaccacccgcaccatactgccgcaacccgctgcgccgcaagacattcccagacttccgattttcggaagtcaagacttcggaaaatcagaagtcaagagttccgaaaaacagaagtcaagacttccggttatcggaagtgcagacttccgaaaatcggacgcaagttatattgaatctaatcagactgatctcagtcagctttatccatttatccatccatctgccacagtcccggagagcagatggatagatcgaagcgagtgccggagagaagtgcaagaagcaatcgaatttccccttctctgccagcagtttggttatgaggacgtggaaagcgtgacagagctgatcgtggacacgctatgcagcacccggcctacctttcgcattggaggggcggaaatgccggccgagcaggtaaaagggcggctgcaaatgttggacaatggccatttggaatatgtgtttgactgcatgagacgcaacacaacagagatacgtaatatccgcgcctatctgttgaccgccctatataacgcgccagtcacaatgagcccctattatcaggcggcagtccagcatgacttttcctatccacagcgggaatgaacaggaggagtagtccttatgagccgttataaaacaaaaaactactccaaccgccgggaatacctggactggctggcggagaggtacggcgtggacagggccgatgttgtgctgctgtcctcgatcctggggaccgaccaggactttgacggcctcccgtccacactggccgacctgtccgccgccaagcacacccagggggcggttttccccacggatcgtcccaaacgagcaaaactcccctcaaattgagggaagttttcaataaaacgccacgacataaaggaggaaaacgactatggcagaccccaagaaaaaccctttgatcggagcgttccgcgccccggtccccggcgcgccgccggacacacccgcgcctccagaggcgggaaaaccgcctgccgctggagccgccaagcctatcgacgagaagaaaggacaggaggcccccaaggcccctgtgagcactactcccaagcccgctgatgggaagaaggagccggaggctcccaaggcccctgcggacacctctgccaagcctgccgatgggaaaaaggagccggaggcccccaagacccctgcgggcactactcccaagcctactgatggaaagaaggagccggaggcccccaaggctcccgcagaccccctcaccaagcctgccgatgggaagaaggagccggaggcccccaaggcccctgcggacacctccgccaagcctgccgacgagaagaaggggcaggaggcccccaaggcccccgcagacacctccgccaagcctgccgacgagaagaagggacaggaagcccccaaggcccctgcggacccctctgccaagcctgccgacgggaagaagtcccctgtgtctgatcccagtaagcccaaggacgaaaaggagcgggagccacgatcccccgatctgcgtttcgttgccctctccaaaatcaagcctttgcccggcacctacgtcaaggacgagccccggaaggattacagtggcctgatcgcagatattaagaaaaacggcctgcaaaagcctatcattctccgccaaagtgagaaagagggcgagttccagctggtagacggcttccatcgctgcaaagcgctagagcaggcggggatgctggaggtccgggcagatgtgtacgaaatgaccttaactcaggcaaacgaataccgcaaggggcaccgggataagccgctcatgccggtccccggcaagctgctcccctatcccccagaggagcccgccaaggcagacaaggctccggagccccctgctgggaaggagccggaggatgaggaactgcccaaagatctgaaaatccccctgaccaaggagggccagccggagacggtcacgaccatgaaggtggcaaacatccggccctttgaggggcaccccttcgcagtccgcgacaataaggatatgtgggacctggtggacagcatcaagaaattcggtgtgctggagccggtcatggtcatcccccataaggacggcggctatgagatggtctccggccaccgccgtatgcgcgcctgccagttggccgggatcgaggatattcctgttatcgtccgcaatctggatcgggacgaggccatcatttccatggtggactccaacctcaagcgggaggagatcagccccatggagaaggcccgcgcctaccagatgaaaaccgacgccatgaaacggaagatgggccgccgcaccaaggaggagatcgcgcaggacgaagctatgggtatcaagcgcatgagtgccgacgaggagctggcccagcaggtgggcgagagccccgccacgatccagcggtacaagaccttgaataaactggtcccggaactccaggacctggtggacaaggggaagatcccggtcaacaccggggcggatattgcccaaatgaagcccaaggagcagaaggtattggcggacgccatccagaaggaggataaagtcccctccggcaccaaggccaaagagttgaagaaggagagccaggccggcagtctgaccactgagaagatcgagcaggccgtagcccccaccaagcgggaggagacacctccgctgaaggtcacaatgctggaggaggatctgcggcccttcttccctgacaagcgcaccactatcccggacgtgaaacagggcatcctggagggcttgaaactgcgtcagacggtcatggagcgccaaaaggccaaggccgcggcgggaaaaaacgtaaaaaaggctgagacgccggtgaggtgaacaggatgagcggaaaacgaatgtgccagagctatgagatcatcgacagccgccgggtgggaaataccgaggtagtgctggggtacagtcccacggaggtctccccctacgtcacctggaagtgttacgcctacgataatttccaggggtacaactatggccgttacttcggagatgagcaggccgcccggaagaatatgaagcagcgggtggatgaactcagggaggagcttccgcccggacacccggactggaagccccggcagcacaggaaagaccccggcatggagcggtaacgtaccatgttcggggctttttttatattcaaatgttccctcaatttgaggggactttccagggaggtgtgaaaaatcgactttcaagagcgtatggaacgtgtgcgggcgctgacggatcaactggaggccggtatcaccggcctgttccagagcggccagtacgcggcctatctgcaatccctctccaaactgcaccattacagttacggcaatatttttctcattaagctccagtgttcgcacgcctccatggtggcggggtatggggactggaaacggaaattcggccgtcatgtcaaggcgggcgagaccggcatcaccatcctggccccttgcccttactgggcgcgggatgaggtggaggagaccggcccggacgggcagaccatcaaggaacagaaatgggtgaaaaaaactggtttcaccacggctattgtgtttgatgtcagccagaccgatgggcgggaactccccagcctgggcgttgaggccctgacgggcaccgtggagggctatgaaaaactgctgtccgccttaaaagccatctcccccgtccctatcagcgagggcctcctgccgccgggcgtccatggggcgtactaccacgcggaacagaggatcaccctcagccccggcatgagcgaggcccagaccatcaaaacgctggtccatgagatcgcccacgccaagctgcacgccctcccggtggagggcgggatcattgtaggggcccatgagaaggaccggcgcacccgcgaggtggaggcggagagcgtggcctataccgtctgccagtacctgggcctggacaccagcgactactccttcggttacattaccgggtggagcagcggcagagaacaaaaggagctgcgcgcctccctggagtgtattcgcaataccgccgcggaactgatcgacggcgttgagagccgctgcctggaccgtccgcccccggagcctgtgccgcagagccaaaagaggtgtaccaagggcaggaagaagcgggcccggacctcaaaagtcccctcaatttgaggggagatttccaaaaccattcgaggagtgaagcagcatggaacataacagccggatgaaggagatcaccggcaatctgaaacaggatgtaaaggatctgctgggcgagagcgccagcctgttcaccggctttttcaaacgaggagcctgtacggtccgggcggtggcggacaagtggaaagcatttgcccacgatatttccgccgctgtggacgacctgatgaagccgcccttcgcggaaggcggcccggaggccccaatggtcaacctggattcggagggcgagcctattgtgaccatcacggagagcatggatgagcgtttccccaccggcaaacagatgtctctctcccaagcggaggagtatgtacgccaggtggatcaggagtaccgggaggctgaacggacgccgcaggcggtcaaggtgaaaatcgactatatgaaagacggccggacagaccgctactggctccctctggagatcggggcgggcggctccctgctggaacagatgcagacccatatcagtgcataccaagacgggcgggcacgggtaaaccagttatttcagagtgtgccgcaggaataccgcacggttttacaggaagaattgacgccttttatccatcaaagtgtcgatgagctctcactcggccttctcccctgtttccagcgccattgtcaggcggcggatctgggaaagcagatggaggagcaggcggcccttctgccggagggggagcaggaagcatttcgctccgctgttcagcagatcatgaaacgcctgcatgagtccatcaatatgggaaaaacgcaggaacagcccgcagtccagcgggaggccccttctgtggagagcctattgtctccgcaggaggacatgacgcaaccaccccaggagagggaggcgggacccgccccgcgcagcccgtccgtaaaggtccgtctgcaacagcttagaaaagacagaaggccggcacccgctgttacacaagtcgaaatggctcctcctgagcccggcagacctgccaaaagcgagtatgacgccagacggatgcaatgggaggctcaggaacgtgccatcccaaagccaaaggccaggcggcccaaaccgcgaaaaggcccggaacgttgagggcagagcgatggaacagcaggaactttaccgctattactccacccagcggcccgtggacatagggacctatcccaaggacccggataaccccctgacgggctttctcaattacgatgagcgtaccagcgtggagcacggcgcgttccgggcctggggggaggtcatttaccgctccccccttaccccggatcaaatatatcagtatgaactgcggccatccagggataaccccgatgtgcgccggacaatggcggagtaggcccaggtggtgggcacctgggaggtgcggaatcatatcccggagagcagacgcctggcccagtatgtccatcccggtaagtttgtcgcgggcaagcgcgtcaccccggaggcgcttgccagacaataccggctggcccaagactatccctttgtttacacccgcggcctgcggcctaaaaagtcccctcaaattgagggaagataacaggaggacgttatgtatcacatcaacgcaagcaaggaacggctcaaagccgtggaaattctgacggtgcccggcctgttcacgatccatcgggtggaccgtgccacactccccccgtggatgcacctctatgaaatgcagagcgaccccaacgactggagccagccctgcctgctggggcggcatatcacggtggagcacttcggcaccgtgctcaccgccagccctctccctctgccgcccagcggctatctggacctggcccccggcgactttgatgaccgtcatggcgaggaatacctgacagcgtgggagtttgaagccaagtatctggacccggactaccagccgcccccggccgtgcgcccggaacagcggcggcacagccgggcaaggatggtgcagccggtaagatgaaagaggcaaatattaaattgttccctgttttggacagattgtgcggccagaccaccccctccacccccgccagtttccgcccggacctctggacactccaggcggctgtgtcggaatacgagatggaggagcggaccttctactggctcccccgttccggcggagggctgtgtgtccgggaacgagatgtgttccttcgcggctcccacggccaccgggtatggaccagccagcgcccggaggccggagaggaggcatactgtgtcgtcctcaagggcagggaccgggacagccccacgggggatatacgctccttcgatttttccgcacacctccgccggttaaaaaacacggcgatggaggccaaagccgtggaactggtcttttattctgggcggcggttttccatggagccggaacggtacagggcggccatggaagatttgttttgggcgtatgggacgctccggcacatccggtatctgcctgaaagtgaggaagccctggtccgcacgatcatgctggagcatcggtatcaaaagggctggacgccgaaaaaggaccgggcgccgcccagcggccaggtcagatagggaggtgaattgcagtatggcaaaaaaatcgttttatgagatcggtcccagtgaaggatatcttcggaagggctcttacctggaggtcaggcggcagatcaactaccggggcgacagggccgacttcaagccgttcctgaatgtcccggtcaaggacctggaaaagcagttaaaggaaagccaggcggaggaaaagaaagtctttgaggagatgaagaaggccgtcaccgcctgggatgagcatggggcgcagacccttctcctgcaaaaagcaatcgaatatctgaaaacgccggaggtcacgcacacccgcaatgagtggcagaggcacaaggacggctcctgggagatcagcaacctggtctataaaatgacattcaacatcgtcaagtctggtgatgaatggaaattgacctgggagttgtcctacacggcccccggcctgtctcaggggtattggggctatacccggagccccagggaacgcattgagtacgagggcagcaagaagtacaagaccatggagggggcccagaagtacatccagagcaaatttgaccagtatgcgccgtgctttgaatccctgtccccgcccatcccggcggaggcaaaggagttgttttgtgtcaacggccaactcctgcaaggatattcgctccaacccccggtcccgcagaaggataaggtcacgctggaggacctgctgaactgcctggaggacggcgatatggccggaccatcggaggcgcaacccgtctccggtgagccggcccctccagcggaggaaaaaccccaggcggggccgcccctcccggtccaggtccaggcacagacggcggacggggggaaacaggagccgcctccggccaaagccacccgcccagccgtcaggaaaaagccgctgcataaaaagcggctggctatggcgcgatagggggcggctatggcatatacgcatattgatcctggacgggaaattgaaatttctacccgcctgtattccagtaaagaccaggaccgcattacggaactggtcaagctgccacgcacagagttaggagaactggaggaggccagtgtggcgcgggagaaagcgatcttctcaaaattctccgaaattgaggccgaatggctgaaacaggcggcggagaccgccgccatccgcaaggcaaagcaatatctgatggccctgcctgtcaatcatacctccaatcagtggaaaaaagaccaatatggaaattatgaacgcagcaacagggtctataagatgacgtaccgcttctatgaccgcacccactatgaccggaccaagcaggagaccgtgacggacgcatggtatttatcctggcatctccattataataccatctgcaatccaaccccggacctcaccggggacggctggcagctcgccgggcaaagcgacaagagatttaccgagaaggcggatatggagcgttatctgcaaggcaggatcaaagcctacgcccacctgtttacggaggtctccccgcccatcccaaagggacaggagggccgtttctccgtcaatggcgtattactccccggctatacggtggaggcttccctggaagaacgggtggaagaaatgctttcctttctggaggacgacccggccctgctggaggagccgctgtcctccggccatcaagacacaccacaagaggaggagccgactatggcacagaagctgcataccacgcctttgaatcagcaccgaaaccgggagagtgttcaaaagctggagaccgcccggaaggggcccaagaaaccgccccgccggaaaacggccccggtacggtgacagcggcacaagcgccgctgtccgcgccagcatggcattttgacagcaaaatgccgctggtcaggggctccgcccctgatacccccacgccgccgaaagtcccctcaatttgaggggacttttttccgggggcacagcccccatcccccgcacaacaccaacgcatatccatttgatatgcgctatttgatacctgaactggaggtgaacagatgattgataaaaaaatgtacgagacccggcttctggagtggaccctgcaacgcctgtttggtgaaacgtcctatcatgtggagagaagcccgtgccggggaaaaatccggggccataacgattattccatcgtgttcgggagcggacggaaactgtttatcagccaggaccagcggaattacctgagcggcctgcggaaacaggttggcctgatccagcatttccgtgaccaccaggccgagaatacagaaaaaatcaaagccgcgcttgccgcccacgacacccccttctgtgatgccgcagtggagatcgttccatacaacggctcgaccgatttggtggtttatggcgtcgtgatcctcacccaccagagcggcgcccaacttctttaccgggagactgcgatgcacttctatctggtagacggagaaaagcatggatattcctttgacaaatgtatagcccacctgctgaaagacgcctgtggagagcgggcttattgcaaggagtttcccctgaaaactccaccgccagagccggaaaagaggccgcagcatcggaaaggaggcccggtccgatgaaaccctataaaaccatcaccctgcggctggatgccgcccactacgtccggctgacggagaccgcccggactgctgggctcaagatcgagcccatgctccgtcaactcattatgggcgtcaatctccgcccacggccccccgatacctacgccgccctgctccgggaattgaacgccatcggcaataatgtgaatcaactggcttatcaggccaacgccagaggcgaggccacccaggaggagatacgggaggcggcgcggctggtccgtcaggcggtccggctggtccgggacacgctgtaatggcctacaccaagattttagtcattcacaaccgcctggacaaatgcgtgggctatacccaggacccggaaaagacctccctggaggccgccatcgactacgccctggaccgggagaaaacggaacagacctgctacgagacctccatcaactgcgaccgggagagggtctatgccgacatgatggacaccaagcggcgctggggcaaggaggggcggaaacgaaagggctaccacatcatccagtccttcgcccccggcgaggtgacgccggaccaggcccatgccgtgggcgtggagtttgcccggcgcctgctgggggaccgctatgaagccatcgtttccacccacctgaacaaagcgcatttacattcgcatatcatttttaattccgtctcctttgtggatggggccatgtaccgggaccaactgaaggactactacggcggggacggcgtgggcatccggggaacctcagacgccatctgccgggaacacgggctgtctgtcattgagcccgttgccccgctgaaagggaggccaatgagccgagccgagtgggaggcggccagacagggcaagtccaccgtgcgggacctgatccgccgtgatgtggacgaagccatccggcaagcctacacctaccagtccttcctcagccaactgcggcggatggggtatcaggtaaaaaccggccccaaagtcaagtacaccgctatccttccccccggtggaaaagggtatatccgtctggacagcctgaaagacggctataccgaggcggacatacaggccaggcttgccgccgtccgctccggcgaggccccgccggacactccccccactacttttttccatctgctggagccgggccgccggtatcgggtgcgaggcaggatgccccgccgcccaaggaaactcacgggctttcaagccctctgcttcaaatacctctgcctgctgggggcatacccgaaacgccgtccgggaaaccgggcggcgttctccatgcgggaggaactgctgaaactggaccgctatcaagagcaattccggtatctccgtaaaaaccacatcgagacagcggcccagctctccatgcagtatgacgcgatacaggcggagatggacgccctcacagaacggcgcggacagttataccggcagaagcggcggggagacggaggcggggaaatccaggcagagattgaacaaatcaccacacacctgcgggcgctgcgccaggacttgaagttatgcgcccgcattgagggcgacatccccaaggtccgggcggcggtggaagcccagcgcccagaccatgtaaggaggcgtccttatgaaaaaactgctccacgcggacctgaccgccattttgggattgataccgctctatcagcccaccgaggcagggagccttgaattggatctgctcaaactgcaacagggcggcgtggcggattatctgtttctggcccggcgtgagaggtcctggctgtttgacccgccccgtgtctatgagccgggcagttatgaaaatctgtgctggctggcctttcaggaccgggccgggtggccggtgctcgccctcttccttcatgtggagaagtttatgggcggacagccctgggggagcgtgaccctgctggactatcggggggcggcccgcgacgtggaggcgttttccgcccttaccgggccccagcggaagcggcgcttgaagttgctgagaaagcggtatctccaaaaagttcagtattgttccattttggaggtcattcaatatttgaaaaccgggaggtgaagaaaatggataacagcggtgaagtggctgacctgatggtaaaggagagcatccaactcaccgaggctgctgttaaaatgctggcggctgggagcaaaaacctggccgcctttctgctggccctgtcccaaaacaacaaaaaactctacggcaaggccaacatggcccggttgcttcaaacgggccgggaactcaagatctttcacatcaaagagagcgacctggaggacttccgggcctacgccaagaaaaatgtgctgttctccgtgattaaagatacccgttccaccagcgggatcgtggatcttgtgaccaatgtggactatgtgccgctggtcaaccactatctggaacagaggggctacccggcccccgccaaagagcaagaggaagaagcgccaaaaaaagccgccccccgcgctcggccagagcactcctcaccacagcgcgggagtggctcgacagccaggcagacgaggagtacggatacgaggacgacggagactactgagaaaccatccgtcaagtcccgcctggaggccctgcgggcggcgtcggaagggatgcgggagactggcagggccccacaggtcaaaggaaaaactgtaccaaaatcaagatgaatatgttttaggaggaacatcattatggcaaatttggaagcaatcatcgctgaaaagtcccagcaggacacccaatggagggcggaaatgcaggcggaccgggagaacaccatctccctgcaagatgccggagtggaggagattaccagcaatccggaactgtatgtgaagtacctggatatgcagggggataacccaacatacagcgcaggcaacatcgccctggtcatgttccaggacccggaggccaccgtattcggtacggcggaacggtggaaaaccctgaatcggggcgtgatagaccaagagcgaagcaaaggagtcaagatttttgcccggaataccctgggccgggggtatcgtctcacagacgcctacgacatccgccagacccagggacgcgaaccgaagaaagtgcagttgagggatgacagcaaggaaatgagcattgccctgcgcgccatcctcaactactccgtcgttcccgtggccaccgaccacgacctgcccgtggccgcctactatgacagcaaaaatatggagctggccgtcaatcccgctttctcagacagcgaggcatttgcggccatcgccgctgaggtggcccactcccgcatccacgccaagggggccaacccaaactatgaccatgaggaggtggacctggacgcccagagcatttcctacatcctgtgccgccagtttggcatcaagcgggacacgccggacctgtcccgtctggaggagctgtacgagggctgggacccccagcagcggcggagcgccctggaccaaattcaggggatgagcaagcagttcggcggctccattgaacggaacatcaccccccagcagagaagccgcatcccgccccagcgccacagccggtaaggccgcagaccgggggcgtctccccgtgggggagactaatccgcccgccgtcccccgtcaaggccgggcgattgccggggcaatcgcccgcgagccgcccagtctgcggactgggcgggccttgaccggggccgtccgccggattatgcggtctccaaggggaggacgccccaaaagccgcctaacggcggcttttgccagtgtggggaacgggtgcggctcccgcggcctctccgcagacggggctcgccgctcaaaagtcccctcaatttgaggggacttttggcccccaggtttcccgttgcctgtttccactccgcatgatataattattctcatagaatttatctcatacaatttctctgaaaggcaggtgactgcatgagcggaaacgctttattagaccgtattgacgcatacgcccaggctatacgggagcgccgccccctcaccccggacgaggtgaaggagctggacgcctacttccgcatcggcatgacttatacctccaacgccctggagggcaattccctcaccctctctgagaccaaggtgctcctggaggacggtatcaccgtgggcggcaagcccatccgggactgctacgaggccaccggccacgccagggcctatgactatatgctggagaccgccaggggcgggcccctgcaattccaggaggaggatatactccacctgcacgccctgttctacggcggcgttgacccggagcacgccggacgctaccgggagggccaggtgttcatcaccggcacggaatatatcccgcccacggcggaggaggtgccgggccttatggccgggctggtagaggatctgaacaaacggaaggacgccacgcacccggtcctgctggccgcctacgcccaccggaggctggtggacatccaccccttccgggacggcaacgggcgcaccgcccggctcctgatgaatctgatcctggtaaacaggggctactgtgtggtctccatcccgcccatcctgcgccatgactacattaccgcgctccagcaggcccagcgggcccaaggccccagcgacgccgcctttatcaaactcatttgtgagtgtgaactggaggcccagaaggattactgccggatgttccgcatcaaactcccggagcgataacccgtaagtcccctcaatttgaggggacttttttctttgcccggaaactcccatcaatttgatggaagttttcgggccatttttgatcgaaggagttgacccacatgaagaaacgcgccgtgcccctgtttctggcggtgctgaccgcctgtgccctggcctgcccggcgctggccgccgaggcgccctctcccgaagccaccccctccgtactttacccagtagaggttttggagtacacggagggagaccgggccgagcccaggatcagcaagacctacgaactctctcctatggatgatccggccctcatccccaccggggactttgagcggtccggctgcctctataccctgctggatattgtcaaggaggaccagacggagacggacagcaagtattacaccgaaaccgtgaccctggacagcaagagcaaggacatggaggagatcatgcccctgctggccgccacctgtgaggccgtcacggaggacggctataccggcctcctcaccctggacaccgccagtatccaggtggaggcgtccggctatgccacgtccacccggaacgtctccgccacccgcagttatcccaatctctccgaggcggatgtgtccctggtgcccaagtctattgaggacagcgggcgcaccctcaccctggcggatgttcaatggcaggaggccgggggcttctacaacgccgccgccacctataccggcaccgcttccagcaaatacgccaccggctacaccgtcacggcggactacgccggagaagtgaccaagactaccagcgggaccgtgctctataccgccgttttcggcctggcagaggagcaggaggccgtaaccgctatcccacagcctgccgcggagggcggcggctttgactggcgctggctgctggtcctgcccgccggggcgggcgttgtcggcctggtattcctgggccgctttctgcttcaaaagtacaaatccaagaaagagtggaaggagtacaacaaatgaggctgaaaaccctttgtctggctgccctcatactggcggccgtctgcgtcaccccggccagcgccctggaatacaccatggacgccccggacgattacctgtttgcccggcccaccagcgataccaccatctatgagcatgaggaccccaacgtggaccggagcaaaaatacagccctgatcccgcccggcttcggcacacccaccagttacctccccggctccggcacagccctgacccctaatctggtccccggagccctggacggcggcggtttggtctcccaagtggggagtgtcacataccctgccgttgatacgggctccggctggaccgggactaccgccacaggctggacggatgtgaccagcgatctctattactccggcgggcacctgggcaccctcaaaattcccgccatcggtttgagcgtcaaggtttacgagggcacggacagcaagaccttagccaagggcgcgggccacttcgaggacaccagcctgtgggatggcaactgctgtatcgccgggcacaaccggggcgtccgggatgactttggagacctgcacactctggagccaggtgataccattacctggactaccaagctcggcacccgtacctatgaggtggtcagcgtccagaaggtaaaggagacggacaccagaggcaccgccgccaccacggataaccgcctgaccttgtttacctgcgtccgggaccaacgggcctaccgttggcaggtccaggccgtgaaatttgaggcgtcaaaacttccctcaatttgaggggacttttgacgcccatttttttgtgcccgaaaatccccaattttaatatttagatcagtttctcaattatcggaaggagacggtgatttttattcatggcctccttctgaccattttaaaggaggcatccatgaaaaaactgatatccctgttcctggctttagtaaccatactcggtatcctgcccacggcggccttcgcggccagctctgaggaggaggctctgggcgaggtcgatatctacaacggtgactatgagctgggctacctctccatcaacggcgcggtcagaaaacaaaaatacacctactttttgtacgaatccaatgatggaactcaaaaggaatctcctgcgtactgcgtcaacccggtgcgccttgttccttgacaatctgcgtagaaatgcgcaataaaacaaggcagattatgaaagaataatctgaactctgtatctgaatcggcgggggaagttcccgcctgacccggtgtgacgggttacaaaagctctgagtctccgacgtgcccatcgcagtgctatgtggtgggtacgaagctcggtaaagtgcggaggtgatatctgagatggtatcacgccgctagaggctataaagcagtcacgcctagtatgtcaaacagaccgacaaactcccgacctaacagctcgtaaacgcaagggtgattatacagccacccgcccccatgtggggtgctgtcgcagctcaataccttgggattgtagtgggccgcagaaaaccaggaatggtcgaatgtcgctggcaaagtcacaccagccagtgatgacagccgggccatagggagaggctaaaactgccatgaaaagctaggatgcagggaacaagggaaccacggacggcacaccggccatcaggacggcgtaagttggttagcacaccagccgcatgagcaggaaatggctcataaatccgtgggacagcagcccgtagtagtgaagaagcccctgtaatgggggtggagcgaaggggcatagtctgtacagggaacatggaaccagtctgtcgaggaagccgtaggcgaacctgactaaaaccatagcgccaaatcttgtttcaaacaggaggtggtggccatggcacaacaattcgactacccaaaatctgaaacagacctgcgtgttatacttgacgcactttataagtcggccagaacggcgcgcgaggcaggaaaccgccccgcattcaaaggactggtcgagttgatgtctgcacaggcaacgattatcacagccatccataacatcaaatccaacaagggaagcaagacgccaggtattgaccacaaaaccatgcagaagggatatctacaaaaaccgacagcatgggtaatccaagatatccaggccgctttccggcattatgaaccacaaaaaatacgccggaagtatattgataaaccgggaaaggcagaaaagcgtccgttgggaatccctacgatacgggatagaatcgttcaggaatgcgtccggattgtgctggagcccattctggaagcacaattctttgaacactcctatggattccgaccgatgcgcgatacccatcaggcgcttgcccgcgtaactgacctggtattccgaacggggtatttctggattgtcgaaggagatatcagcaaatgctttgacaggctcgaccacaatgtcctgataaaacggctctatcacatgggcatcaaggacagacgggtactgcaaataatcaaggcaatgatgaaagctggtattatcggagaatgtgaagtcaatgagaagggcgtacagcagggcggggtactctcacctctgctggcaaacgtcagcctggacattcttgaccaatggataaccagccaatgggaacagaagaaaaccagattcccttacaaagactggaaaggtaagtcggaggggctccgtaagggcagccgcttgatacccggctacctcgtccgctatgccgacgactttgtaatcattacagatagtcgagagcatgcccagagttggaaggaacggctacagcagtatcttcaggcggaactgaaactcgaactatccccggagaaaacgctgataaccgacctgcgtaagcagtacatccatttccttggatatgaatacaaggtggtcaaaggcaaaggattaaaaggttacattccacgtacgcttcctgaccgaaatcggctgaagcgaaaggtggatgccattgcaaaagaaacaaagaatattccgtacaactacagccgagaacaggtcattcttgcaattaaccggattaacagcgaaataagagggcttatcaactactactccaattgcacttgggtcaatattgccatgaaaaagtatgcccattggcttcagagcatcgctatgcaccgtctgaagcaatataagggcaaatggatacccgcaaaagagacccgaaacttgccccgtatacatgagaagtacaagcagaaaataccctctattcaataccgggatttctatattggaatgacctcactttctttttgcaaatgggaaaagccagcggtaaagcaccacgaggaaaccccatatacagagcgcggccggcaactgtacttcaggcggacaaagaagaaacggcaaaatgcccgcctggatcacatgtacagtagcagtacagctcaactcgtggcacagggacgatggaaaaggaacttcaacttcgagttctatatgaatcgggcctatgccctgaaccgggacaggctgaaatgcagggtatgcggcggatggctgatatccagcgccccatatgcccaccatattgaccccaacctaccgctggacaaggtgaacaaagtaagtaacctggcgtccatgcacagagaatgccaacaggcaatcctgaatccaaatgctgatatcacacaattcgactccaaggcacgcagaaaaatcgaagaatttaggaaaaagctggtttcccatgccaaaacaactgtatagatggagcgccgtgtgcggtgaaagtcgcatgcacggtgtgaagcgggggaaaatccaccctgactgctgcattcaaatggatgcagtaaaagaggtggattacctatcgctataaccagtacggcgtaccccagaccgtagggcccggcgagagcatcaaatatctagccgaagaaaaggccagcgaccccaaggtggtgggcatcatctccaacggctacccccatcggagcctgggagagctggagctggacaataagtaccaggcgtattatgccaccaaaatggcattgtggtgctacctgatgccggattggaatatcgctgacctcaaagttgcgccggggctcaccggctccgagctggacatcggcaaccgcatcctggccgccgccaaggacatctacaagcggggcactacctacaactatatgctctctccccggatgaccgtcacagcgaacaaatccacggcctaccccgtgaccatcgggggcgaggaatacaagcagcaggtgttcaccgtctggagcgagacgtgggtatatgattacgacgtgtccgtggccttttccaatcccgatgaggtgccggagggcacgaaaatcgtggacatggaaaataacgagattaccgctgtgaccactgagggcaccagcgacggctatgccgggcagttcaaggtgctgtaccccgctgaaagcgtggcgggccagagcggaaacgtccaactctccctctccgcatctgtggcccagtacgcggctatgtacgccgtgtgccaggagaaggaccagtacggcaatttgcagaattacatctgcgacctggacaacaatgcgcggttagacctggccgccatcagcagctactccgacagcggagaacccgcaccggatgagacggccctgaagatcgtgaagctggaggaagggaccgagattcctctggaaggggctgtgttctctgtgtatgacccggagggccgcaaggtgggctcttactccaccgggccggaggggacggtcctgatccccctgaccttggagggccattataccgtgacggaggagatcccgccccggtatcacctgctcccggaggagaccacccagcacgccgatgtggagtataacaaggttgccactgtgacctttaccaatgccccctatggctccatccgcgtccagaaaatgagcgacaccggcgacgccctctccggcgtcaccatccagatcaagcatattgagaccggggagacccggaccgaacagacccgcatcggtgtggcgttctttgaccagttggcccctggcggctgggaggtccgggaggcggccggtatcgagggctggatcgcggacacggacacggtgcagacggtggccgtggcagccggagaagaatccagcgccaccatagtcaacaaggagctgcctggactgcggatcacgaaatatgagcgtgggaccatgaccctcatgcccaatgtctcctttgagattttccgggacgccgagagcctgggtatcttccagacggacgagttcggccaaatcctgctgacagactgcgcgcccggcacctaccgggccgaggaacgggacacaggcggggacggccatgtgctggacaccaccccccaggaagtggagctgaaggccggggacggtatcaaagagctggttttcttcaatgaccgcctgcccggcatccatctcatcaaggtggacagcgccgacctctcccagcccatcgccaacgcccgcttccgtatcgaggcggtggacggctcctgggggccggaggagtacaccacttccgaggacgggaccatcgacctgagcaagctccccgccgataccgcctacatcgtgacggaactggagtgccccggctatatcgtggacgacgcccagcgcatcatccacctggacggcggcgagcaggcacaattcgtgttcaccaattccaagatgccctccctgcacttatacaaggagagcgcggacggcacgcccctgggcggtgtgacttaccggctggctaagattgaggacggcgggcactacctggaccgcatcaccgggccggacgggaccatcacctgggaggggctggagcctggcgtctattccctggtggaaaccgccacggtgtcagatcatattttagacactcggaagcaccatgttcagctctttcccggcagggacggcactatcgtactgcaaaatgatagacggcctgatttgaccatccacaagagcgacgccgacaccggcgcgccggttcctggcacggtgttcctggtcaagggggcggacggtcatagcgtggccgaagtgaccaccgggccggacggctccgccacggtagagaacctgctgcccggcgtctacgaggtctcggaaaagtcggtgccgtctccctacctcccggatgccgacccccaactagtcacgctctacccgaaccgggaccgggatgtgtattttgaaaaccacaagcggcccaccgtcaccatccagaaggaaaactccgtcacccatgaccccatccagtacgccgagttccatatcacctggtccagcaacaagacggagaccggggagcaacgggacctgggcaccttccagacggatgaggcgggccagatcgtcctggagggcatcgaggacggctggctgaaaatcgaggagaccaagcccgcccccggattccaggccccggaggacccggttacggaggtctatgtcaagggcggcgagaacaagactgtcactatctccaacacgcccctgtcggccctggtggtctacaaacgggacagcgtgaccggggccggaatttccggctgtctgttccaactgcgctatttgggcggcgagaccagcggcgttggcggcacggtggtgggcacctatgtgacttcggccaacggctccttcaccgttaccgggctcaaaaagggctactacatctgcgaggaactggagagcgacagcggccatgtgatcgacgccgcgccccaggccttctatatctccggcgcgaaccaggacattgtgaccctctacttctccaacgcccccaaggggagcgttttggtgaaaaaggtatcggccagcgataacgccccgctgagtgatgtggaatttcttgtgactacctcagacggtgctgtggtgggcgatgccaacggcaagtttgtgacggacagcacaggctctttcctgatttccggtatcgacccaggcaccacactggtcatccgggagaccagggccaaggacggctacctgctggatgacgccccccagaccgtccaggtcaaggagggccaaaccgtcaccgtagagttccgcaaccagcctatggggaacctcatcatccacaagctgtccagcaaggataagaccccgctggagggagtacagttcaagatcacctatgcggacggcacctatctcccggacgagggcggcaagctgtcctccaatggcctgtattggaccaatgcggagggccagatcgtcctctccggcatcaccggcacagtggttgtgactgaggtggagagcatccccggatataccatcgacccggacacacaaagtcagactgtggtggtcaacccggatgatacgcaagaactctggttctacaacacgccggtgggcggtgtggagctcatcaaggtcagttcggcggataagacagagcgcatccccaacaccaccttcgatatccgccgggtgtcggatgacgccctggtggacactgtgaccaccggacggagcggcaaggtgtatctgcccctggaaagcggcgattactacgccgttgaaaccgaggccgcagatggattcaagctggatgacactccaatctattttacagtgaaggacgcagagactacccgcaagactgtgaccaacgcgcccctctccggcatcctattgcataaggtctccaccgcggacggcgagggcatccccggcgtgtcgttcattctctacgatgagacgcacacacctatcgaccagcagaccacggatgaccggggctatgcctggtttgaggacctgacggagagtggccgctactatctccgcgaattagagaatgagggctatatcccggacacccaactccgcaccgtctatgtcaaggcgggcgaggtaacggaggttgaatgggagaatacccccatcacaggccaaatccagatcaccaagaagtctgccgactacaaccccaccaccggcctacctgccgggacgctgctggagggggccgtgtttgagattacggacaaggctgggaacgtggtagacaccatccgctctgacagccgggggctggccgtgtccaaacagctccccctctcccgctataccatccaggaggtcaaggccccggagcattacggtgtcaacgaaaccgagctgaccgcctacctggagcatgagggccagatcgtgcggtttgaagtgacgaacaagagcctgtccaccggcgtgtccatctccaagaccggcccgaaagaggtggtcagcggccagccggtccgctacaccttctccggcatttctaatacctcaaacgtccgtttggacagtttctatttccgggacaccctgcccgctcaggtgcggctggagcaggtggtgacaggtacatggaacttccccggcgtctacaagatcgtctacaaggtcaacgggaccggggattaccgcactttggcggataacctgagtaccagtcagacctacaccctggccgcgtcccccgcagccctgggccttgccgccaatgagcgcgtgacggagatcatgttcgtattcggccaggcccccgcaggcttcgcccaggtggaggccccggtcctctactgcacttccgttaatggactggccgcgggcagttcttttgtgaacgttgcggacgtgggcggtgtctataacggccagtgggtccaggccgtcagccgctgggtaacgaccgtgtacggtaagccggagcccctgccccgcaccggatattaaacatcaagcccggagcgtcaaaacttccctcaatttgaggggagttttggcgccccctttggaaggaggaacgtatgccagactatcaggccgttttaagcggccatgagatcagcaagaagatcgctgacctgctggaggatattgactccatccagtataacggcagcaaccgggcccgccgtgtacggaatgtgaacgactatatccagggccggaacgatatgcctctggaacccctgctggattgggcggcaaaagcggatggaggggcctatgccgggaaagtggcggtgctccgccagtctatccgggactttcaagcgcaaaaggccctgttggccgtcccctataccaggaccagccataagcaattcgagtacaagaccatagaactggagatggaccggcccctgaaggtcataaaccagcagatctatgaccgggcagcgaaagcaggttttccgcgtaatttcttccaggaaagctattttgaccatgtgacgctctattgtatgccggacaatgccaactgtaacttttctcatttctccgactgcacttttcatgtatgccgcctgtatggggtgaaattttgggatacgaggttatatggctgtgagttccactcctgccggatcgaatttactttattcccggattccacactggcaaacacgcatttccgggactgctccatccattccgcagcctttctccgcagtcgtatgacccgctgcaacacggttgactgttccgtggggcggctgaacttcaacggggcccgtctggatggctgtacctatggccggatcacacgattgcctaatagccggatcgagggcctggaggacgcttctattacgatgggaggggcgacccaggaggaagtccggtataaccgtaacgccattttccacgccctgggggagcaagccccggaacacctcccgtccagacaggaccggccgcccgcgccggagcggtgaggggggcagctctatgcgtagaaataacaccgtaagccctctcatgtgggcggcgctcaccctgcctgtcctctatctggcggccctcctggcctccggctatgaggagggtatgaccgtctttgacctcatgggccgtttcagcggactgctggagcggccctttgccatcctctggacgcctcacaccccgaagtttatgctgggggccctgctgatctacggcttctccgtggcgctctactgctccaccagggaaaacaggagacccggcgaggaacacggctccgccaagtggggcagtccaaaactgctcgaccgcaagtaccgggacaaggcaccctttcagaataccatcctcacgcgaaatgtccgcatgggcctcaacggaaaggtacaccgccgcaacctcctgcaaatcgtcatcggcggctccggcgcgggcaagacaaggtttttctgcaagcccaatctcatgcaggcgaattgcagttttctggtcacggaccccaagggggaaacgatgcgggccgtggctccgctgctcctggaaaaaggctatgttatcaaggcgtttgacctcattgacaccgaccactccgacgccttcaacccgttcccatacctgaaggacgacaaggacgccatgaaactggtgaacaatctgattaagaacaccacgccgaaaaattccaccaacaacgacccgttctgggagaaatccgagattgccctggacaccgccctcatcctgtatttgctccatgaggccccgccggaggaacaaaatctggagatggtcatgtatatgatcgagaacggcggggccagagaggatgacgatgattttcaatcccccctggatatgctctttgaggcgttggaggaggaagaaccggatcatgtggccgtgcgggagtataagattttcaagcaggccgccggtgatatatgctctaagtgacttcttaatcatgattttgtcatggttagtgaagcaatcacttagagcatttttgtttcaggaggtacagctatgagaaacgaaaaaatcaccccactgtacgagcgcctgagccgggacgatgagttacagggcgagagcaattccatatccaaccaaaaacagatgttagaggattttgcccgccggaatggactgccaaaccctacgcactttaccgatgacggtatctcaggcacccgttttgaccgccctggatttttggcgatgatggaggaagtggaggcagggcgtgtagaggcaatcgtcatcaaggacatgagccggttggggcgcgactatctgaaggtcggtcaggtcatggaggttttgcggcagcgtggagttcggctgatcgccatcaacgacggtgtggacagtctgaaaggcgatgacgattttaccccgttccgcaacatcatgaatgaattttacgcccgtgataccagccggaaaatccgctctgtgtttaagtcaaaaggcatgagcggtaagcacctgacaggcaccgtgatttacggctacttgtgggatgaaaagcgggaacattggctggtagatgaggaagccgccgaagtggtacgccgtatcttttccctcacgctggagggatatgggccttatcagatcgcctgcaaattatccgcagaccggattgaaattcctgtcgtacaccttgcccgcttcaacgagggtgtgaaccgttcaaagccggtcaaagacccctatggatggggatcatctaccatcgtgaacattttgaaaaaacgagagtatttggggcacaccatcaatttcaagacccgcaagcactttaaggacaagaaaagccactatgtttctgaggacgagtggacgatctttgagaatacccatgaagccattatcgaccagcagacctttgatctggtgcagaaaatccgcagcaatgtacggcgttatccaaacggctggggcgaagcagctcccctcacaggcttactctattgtgccgattgtggcggcaagatgtatgtccaccgcaccaacaatggcaagcggatttctcaatatacctgttccaattataccaaagttccgtgtgggacactatgccttacacaacaccgtatcaatgagagtgctgttctgacattggtttccgacacactccgggctatcgctgaatattcgagaaatgaccggacggaatttattcacactgttcaggagacgcaggttgctcaacagagtgccgatatatcgaaaaagcgcaggcgtctggctactgcccaaaagagagccggagaactggaaaaactgatttgcaaaatctatgaggataacgccctcggcaagctgccggatacacgatataaggcgcttgatgcacagtatgccaaagagcaggacacacttgagattgaaattgcggagttggaaaaggctgttaccggctatgagcagagccagaaatcagcagagaaatttatagccctgattgataagtacgagaattttgacacgctgacaaataccatgctcaacgagtttgtagagaaaatccttgtccatgaacgctcccgaaaaggcagtcaggataccacgcaggaaattgaaatctactttaattttttaggacgctatattccaccatccttacagccggttcctttaaccacggaggaacaggaagaactgcggaaaaaagaagaacgcaaggacaggcttcatcagaactatttgaagcggaaagccagcggcgcacaaaaacgatatgaggacaaaatcaaggcgaagaaaaaagcggaaatggacgctaagaaatccctgatccgggctgaggacatgaaaaaaggcgtttattctactgttagccagctgcctaaagaagaaccgcgcaaaggcagcatagcagccagcgcagcggtttaaccatcacggagcaaaggagcatgaatatgaataagttgacttacattcgttgtggagattatgatatacccaacctaaaactttctgaacagccggaaacttctatcggcaagtacggcaggatgcgaaaatcctacctgaaggaacatcgtcctattctctacaaccaactgctgatgagcgagaagttgtatccacacctgttagagattgaccggacagcgcaggagcgtatggacaccatgttacctcacatgatggaggctgcgggtgtcacggaggaactgaaagcctgtgatcctatgcgttgggtggggctgatgaacacattaacggcacagattgaggaaattttaatcagggaactgatttgcagctgaatgggaggtgcgggaaatgctgacctttgaaaaggttttgaaagtgtttcaggcatatctggatgatgatcctctgtatgaggtggtgcagaccagccacggttatacattgatggcatgggaacctcaccggaatgactggtacagcgccgaaatacagaaaactccggaggatttacggaacgctttgttgggtacatacgccaactttctggaagataagattaccggaaatgaccgcgagctgactgtgacagaaaccggagaaatccagcagaggtgccgggaactttgggaaaagtgccgggaaacttgatatagaaacgccagaaggaggccgcgattatgcgtcctccttctgcttcgcagtgtgttccattttgagcgccccgtctatggcaccttcgataatcggcaggtattcttcagggcaaagcttcagcttgtggctgacccgttgccgctgttcgctttcttcccgcatgatctccgggttaaaataccgttccacaggaagtccgcagatcttaatcaactggatcatcacaggcaggctcggaatcgcaccttgattctcaatgttggcaagataccgccattcaatcccaaccatttctgccaatgtttttcgtgccagacgctttgcctctcgtgcggctttgacatctgcgccgaaggtttcaaaaccgggacaatcttcaactttcgccatataacatcacccggttacattgtataattcatactttgcccgtggaatgttgctatatgcaggttagttgaagtttataattcatatttcgtttcttgcattgttcgagaaagagaactataatatatcctatggaggtgcgaaatggactatatgacattgaaagaggccgccgagaaatggggcgtaacacctcgtagggtaaattattattgcgccggagggcgtatccccggcgctgtgaaaatggctggtgtttggcttctcccaaaaactgcggagaagccgattgatggtcggacaaaacaaggaaaggaactgcgccatgaataaaattttgattatagatgatgacagagaactgtgcgctttgattaaacgcagcgtacaatcggaacatatagaagctgatttttgtaataccggaaaagagggcttgcagaaattaaaagaccaggagtatcagcttgtggtgctggatgtgatgatgcccggtatggatggttttgaaacgctggaagaaatccgcaaagagaacagcctgccgattttgatgtttacatccaaaaatgacagcatttctaaagtgcggggattacgggctggggcggacgattatctgacaaaaccgtttgatatggacgaactgattgcccgaattgtttctctcattcgccgctacactcgctttaatcagcaagccggagctgtgcaaaaactggattttgacggattgcagattgaccttgaaaatcgttctgttacgacggcaaacggcacttttgaacttccgccaaaggaatttgatctgctcctgtactgtgcaaagcatcaaggaaaaattttgaccaaacagcagatttatgaggaagtatggggtgaagaatatttctatgacgacagcaacattatggcgatcatcagtcggcttcgtaaaaaattagaagtcaatccttcaagcccaaagtatatacaaacggtcaaagggattggctaccggtttaataaggaggtgtagccagcatggaaatcatcgttttcttgtccattgtgattgctgttgtggctgtgttgacctccatctttcttgtccggcgtgtaaaaaagcaaattgcagaaatgaccgatgcactggttgatgtgaaaaatggaaatggcaatcggcgtattttgtctgcaacaaatgaactgacagcacctattgcctatgaaatcaatgagatcgttgtggcctatgaaagcagactttcaactgtacggcagacagaggaaaccaaccgccagcttatgacgagcctttcccatgatgtgcgaacgccccttactactctgattgggtatcttgacgctgcacacaaaggactggtcacaggaagagaccgggatgatgatattgaaaccgcccgacgaaaagcccatgatctgaaagaatatattgatgtactctttgactggttcaagttaaattctgacgagtttgctttagaaatccagagcgttgaggccgcagagctgacaagaaatatcctgattgactggataccgatttttgaggataaacaggttgattatgacattgatattcccgaacagcctgtccgggtaagattggatatggacagctatatgaggatcgtcaacaatctcattcaaaatgtaatcgctcacagccatgcagacaaaatcaaaattgtcctgtcaaagaaggaaaataacatggagctgctgctggcggataatggagtaggaattgagaaagaagatttgaaacacatttttgaacggctttataagtgtgataaaggacgctctgagaaaggcagcggtcttggtctttctattgtccaccagcttgtagaaaagatgggtggaagcataacagttgaaagtgtaccaggaaaagggactgaatttatgttgttttttcctttggagatttaagcgggttcccgtctttatggcgggaacccttgtcattttggccggattctaaattgcaaggttaatgcaaggttgcggcaaggttaatgcaaggttggcgtgatagaataccttacagaacaggaggttttgaatatggatacaaattacatcattgaaacaaaaaatctgacgaagcaatacggctcacaaaagagtgtggctgacttaaatatccatgtgaagcgtgggagaatttatggtctgctgggcagaaacggagccggaaaaaccactactatgaaaatgttgttgggcttaacgaagccgacctccggtgaggtcaaaatctggggaaaatctttgcaggggaatgaaaagaaattgctgccccgtatcggcagcctaattgagtcccccggcttttatcccaatctgaccggcacagagaacctgcgtatctttgctactctgcggggcgtaccaaacaatcatgccatcaaagacgctctggatttggtaggactgccctacaaagataaaaagctcttttcccagtattctcttggtatgaagcagcggcttgccatcgcccttgctgttatgcacgatccggaactttcaattttggatgagccgatcaacggtcttgatcccatcggtattgcggaggtacgctcctttattcgggagctttgcgacgcaagaggaaaaaccattttgatttccagtcacattctttcggagatttccttgctggctgacgatattggaattatagaccacggtgcattgctggaagaagaaagccttgctgagttggagcaaaaaagtagtaagcatatccggtttgcactctctgatactgcgcaggcggcaagaattttggaacgaaatttccatgaaaaccatttctctatacaggacgaccacaatctgcgcctgcacaaccttgatctgcctgtggggaaaattgtaactgcctttgtagaaaatggattggaggtatcggaggcgcatacttgtgaagaaagtcttgaagattacttcaagcgtgtgacagggggcgaaggaattgcttaaactaatcaaatgcgaatttttgaaattgaaacggaagaaatttattccgctgattattctggctgctttctgtttccaatcccgctgacttatctgatgacaacgccctctatgatggagcgatatacggatcaggcagatgctttcgacggactatttaacatggtgttaggatatggtatccagtttttattgccctgcattatcggtgtgattgccgctatcctgttttttatggaacgcgacaacgacacattcaaaaatctgcgtacaattcccgtaaccagcacgcaaatggtgcttgcaaaaattgttgtcctgtttctctttggaattgttttttgtgtggcttctaccattgcaacaattctttgcggatttggaacattagaagtttatggaacaggctataaattgtttttagcagttgaaacaggaattttcattacggcaggaacactcccgttgattgttcttgttgtctttttcagtaagacctatgttttttccattttgctgtgtgtcttttacagcgttctgaacatgagtgctacggcattgtttgacacactgcctaaaaccatgttatggcttctgcccacgccactgactacattttggagtgcaggagatatggcggctcatggaataaaaatggacttggagcaaatgacagggctaattccttcaacatttcaagttgtattcattcttgggatcatggcattagtttcgttcttactgattgacagattatataagcagaggggggaataaacatggttcgcattgtaaaaacagaattttataaattgaaaaggtatcatatcctttgggcgggtgttgcgctcatgctcctatccgtcttgctgaccttgtttacctctatggcgaatgatggttccgtttgggatttcgcctatcttacagaacaggtcatcaaaaacaatatgtccatgatttttccgatgtgtatcagcctaattgctggatatatgatttctcgtgagcagacggatgacacattgaaaaatattctgactgtgccgatctcttttaagaaactgctgaccgggaaattgattgtgtgcggcgtattgtctattattttcgggctgatatgcagcctgtttacaatcatagcagaaatgattgtgggatttcccggctttgaaatttccttagcactaaaagcaaccttgcagattaccgcggttaatttctttttatatcttgcggttctgccgattatcgctcttacttgtcggagggcgggcagctttttagtcggtgtaatcattgcttttgtctatggatatggagggatgtttgccgcaggaaatatgacattagcaaacctttatccgattaccgcaagtctcggaatggtaggctaccgtagctatgataccgcagtcaactggaatatcggaacctgttcttgcagtcttgtgcttgctgttgttatttctgccatcttgattttgtgcatgaaagagcgagaagcaacccaaacaaagaaaaaggccaaaaaggtagcaccaaagaaaggctggtgatgattttatgaagaaaacagttttagcattggcatttgttctttttggaagttttatgctttctggctgttcaaaagatgaaattctcgatcattataataatatcgttcagtcagctggaaccatagagcttacaggaaagttatctttggaaggaacaaaagaaaaagggatcgatgattatacgggaacttatacggctgattatgagaatttttcagatacagagtatgtgttcggaggaacttccataaaaagagaagccggtaaggagctgtctattgactgcactttggaggttacggaaggtactgcaaaagtattttggatttctggatcggatgaagcagtcactttgattgaaacaaccggaacttatagtgacacaattacacttcctgatggtggaaattatatcggcattgagtgtgaggactttactggaaacattgaattgaatattgaataacattctgccgcacgacggcaaaagaaaaaagccgtcgtacagcagacacatttccacgcgcctatgaagcggcggctttgagaagatcagagccgccgtttcttttcgtctatcccaatctaacgacgacctaacaccgtgtaaatccacggcggcacataggaggattgccgccgtgtctatttttgccttttttcacagtccccatgacctgcaccagctaaaaaaagcctgttcccagcagcggagcaatgcggtcagaagtatgcactataccatgtaactaaacagcaaaatatactctattacgctcgtatggctttatgccgtccgggcgcttttttgtccctatggagccgaaacatcgggccagcatggcccgaaccctggccccagtgccgttctccgccgccccattcagatttaccaaaaaaatctgaatggaggaaagacagatggaagttaccatcaattataacggacaagctgtggccgtggaggttacgctggaagtctatgaatttcttgaccgggccgatcataaaacggagaacctgttccatgaacagcggcggcattgggatggccgggagtttgacgagtacatcattaccaccgagggtgtaggggtctacggcgaaacgccggaggaatacctttgccgcatggaaacgctgcatgagctgatggctgttctggacacctgtaccgaggcccagcgccgccggttcctgctctatgcgcttgacgggctgagccttgcagagattggtgtgctgtgcggctgctccaaagtggctgtgtatcaaagtgtggaggcggtcagaaaaaaatttataaatttctttgagaacaggcttaacgaatgacctgttttctggctaccaagtgaaagggatcatttcccttatctcagcgaggggcggacagcggacgagctgtccgcctctccgattttcaggaggtaagcctatgaaaacaatcaatctgcggtggatgtatccccactaccggcatgacgagtttgtggatgttacggacgaggtatgggcagcgatgtatcaggccaagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctatacctaattgcagctttgccggtggctctggctcatgccactccgacacaggcccgccgtgttcacgcctactacattgctggtatcaagcagccggaaatctctcggatagagggcgtccacagcagcaaggtcagcgttgccatccgtcgaggtctgcggaatatgcgccgctgctatgatggctttttccaaacagagtgagggcatgcctatgcagaccatcaatctcaaacaatattatccattttgcaaagaggacatttttgtggaggtgtccgatgagatcgtcgaagcgtttcttctggacaagagagccgaggccgccagagatcgcaagatgttccggtataaggcgttttattccctcgattgtaacgatggaatcgaaaatgccgccatcggctgggcgcagccatcgccggaggactacctgatagaaaaagaagaattagccgaatacgaagaactgatacggcgattgtatgaagccatttcctccctgccgcctatgcaggctcgccgtgttcacgcccgctatatgctgggtatgaaagtgaaagatattgccgcaatggagggtatcacgccagcacaggcgggaaaatccatccatgccgcactgcggagactgcgccggtactttgctcgacagaaatggacggtcaatctatgagtatttccaaagaaaagaggtgcctgacatgaacgaaaaaattacagcccacccacaaaaagaagaacgggaggaagtcctgaaggagatccggcagcttgaaaaccgcaagaagattttggagaacaagcagcggaacgaagaacgcagggttcgcacccgccgcctgattgagcgcggagccattttggaggggattttcccactggcttccaacctttccggcgcagaggtcaaagcatttctgattaccctgtcccatcttccgggggctgcggaattaactgcaaacctgccaaaatccggggacacgccataagtcccttgtttacaagggcgcacttatacaccgttgccggtgctgtgcgccctgccgggggcgttgcgtacttcgtccgcgatgggaagctacgctccccaaaccccttgtgcgctctgcgcagtcgtcggacacccgctttgcgtttgtccggctccacagagcctgctatccccctcactgaaaggaggtgttccccatagatttctgtcatatccccgtcagtatcatcaagcgcagcgcaggccgttctgccgttgccgcagctgcttaccgcagcggaaccaagctgacaaatgaatgggatggaatgacccacgactacacccggaaaggcggcattgtccatgcggagatcatgctgcctgcccacgccccgccagaatttgcagaccgttctatcctctggaacagcgtggagcaaatcgagaaagcaagggacagccagcttgcccgtgagatcgaggcagccctgccccgtgaactgtccggcgaacaacagcttgcccttgtgcgtgcctatgtgaaggacaattttgtagacaaaggaatgtgcgccgactttgccatccatgacaagggaaccggcaaccctcatgtccatatcatgctgacgctccggcctctgaaagaaaacggacagtggggcgcaaagtgccgcaaggcatacgatctggacgagaatggacagcgtatcccggatgggaaaggcggctggaaaaatcatcgggaggatacgaccgactggaacgataaaggaaatgtggagatttggcgggcagcgtggacagcctacaccaaccgggcgctggaatctgccggtagaccggagcgcattgaccaccgcagttacaagcggcagggcattgataaaattccctctgtccatctggggccagctgccagccaaatggaaaagcgcggtatccgcaccgacaagggggaagtaaaccgacagatcgtcgccgacaacaaactgctgaaagaaattaaagcccgcattacccgtctttatcgctggtcgaaagacgaagcggaaaaaccacaaacacagcaaagcagcttgactgctttgtgggaggcccagcagcagttgaacactccccgcacccgcaccggcaaaatccgggctttgcaggaaagcgctgcactattcagctttttacaggcaaacggcatccagtctatgcagcagcttcatgaaaaaatcgctgatatgaacagccgttactatgaccttcgcggaaagattgtcaaggctgagcgccggatcgccattcttaccgaacgcggggagatgtgggaacagtacaaccagtacaagcccatccacaaacagcttgccaaagtaaagccggaaaagcgggaacagtttgagcagcgccacagccgggaactgatcctgtatgacgcagcagcctggtatctgaaagaactgaaagacagcggcgaggggatcaccccgaaggcatggcagcgggagatcgaccagctgaccgccggaaagcagacggacacgcttgccatgaaatccatgagggaggatttgaaagcagtggaacggctccgcaaaaccgccgagcagctgtcccgacaggaaagggacaagtctcacgaccgtgggccggagcggtaaaggctaccgcgttttggcgtacccctgtcaagtgtgtcgcgtttcacgacatacctttgcatacagaaaaaccgccgtacaggtttccccatacggcggcagactgtttatttgccgaacaagtcgctgtgtgtgccggtgcgggccagcgtcagcaccagaacatcatcctctatgcggtagacaagcagccagtccgggagaatatgacattcccgatggcctgcccaatcgccggacaggtcatggtcgcggttcttatccggcagcggttcgcccattgccagcaatgctacgacctgctccagcagctcaatcttcaagccacgctttatggctcgtttgtagtcttttttgaaactggtcgtgtacttgacggtatatttggtttctttcatcttttcaggtcagcaaacaactcgtcaaggtcattgtagccctttacagacgggtcttttgcaatcctttccgcttccagcatggcagcaaccgtttctttgttcggctgttccagccttacctcaaagggaatgccgccttcacgaagcgactggcgcacaaagatgttaaacgccgtagtcaggttcatgccaagttcagtaaacagtgcgtccgcctgcgctttcaaatctgcgtccatgcggatactgatgtttgtggtatttccagccatacgatcaacccctttctgctggcaattatagcatatgccatttgcacgaagaaaacaatactttgcacgaatatttaacaataaattcattcgaggaggttacacgctttatgaaagaaatcatttatgaagaacaacaagactgaacctatccctgtcatggattaccgccagtaccgcagagcgcggaggctggtgcatgagtgctgtaactacattgacggaaactgtatcgccctggacgatggggaggaatgcatctgtgtccagtccatttcctactccctgttgtgcaggtggtttcgggcggcggtattgccgcaggataaggaactggaaacggcgctgttccaccgactgaatgctaagaaatgcgctgtatgtggggcgctgtttacccccggttctaacagggccaaatattgcccggaatgtgccgcgcgcatgaagcggatcaacgccgcaaagcgcaagcggaaacaacgggagaaatgtcacgctttaggggctgaaaaacccttgtaaatcaaggcttttttcgagggtgtcaaaggcaggctgatagatttatcctctgactcctaaaatagccttaaaatgcgtacagaatcccaagagaatccccaaggaggaaccctatgtcagacaatcgaaaatattattacctgaaactcaaagaaaactattttgacgatgattctatcgtgctgctggaaagtatgcaggacggtgtgctgtattctaacattctgctcaagctgtatctgaaatcgctgaaacatggcgggcggctccagcttgacgaggacattccttacacggcgcagataatcgccaccatcacccgccagcagatcggcactgtggagagagccttgcaaatctttttgaagctgggtcttgtggaagtgctggacagcggcacattctacatgagcaacatcgaacttttaatcggccagtcctctaccgaggctgagcgaaagcgggctgcaaggcttcaaaataaggctctttctgcgctccggacaagtggcggacatttgtccgacattcgtccaccagagatagagatagagttagagaaagagataaagataaagagagagatagagaaggtacgccctgaaatggggcacccttcccacacctatggccgttaccagaatattttcctgacggatgaagaactggctgacttgcaggccagttttcctgctgtatgggaacagtacatcgaaaaactgtccgagtacatggcttctaccggcaagcgttatcagagccatgcagcgaccatccggcgctgggccggtgaggacgctaaaaaaactgtcacaccctcacgcaaccgggattacagcgtaaaggaggatgaaactgtatgattgagattaccgcagaaatccgggcgttcatcgacaaggcagctgccggtgtggaattggctgaggacgagtatatagacttgtcagacgggctcattcactgtaagaaatgcggcggccagaggcagaccgttgtgccatgctttgggaaatccggctactttatgccgcgttgcatctgccagtgccagcgggaagctgaggagcagcgcaaggctgctgaagaacggcagcgccgtatggagcgtatcaaacgccgaaaggcacagggcttgcaagaccgttatctgtacgactacacattttccaatgataacgggcaaaacccattgatggacaaggctcatgcctatgtggagaactggaaagaggcatataagagcaatatcgggcttttgctgtttggagatgtgggaaccggcaagtcttttttcgccggatgtattgccaacgctctacttgaccaggatgtgccggtgctgatgacgaactttcccaccattctgaaccgcctgaccgggatgttcgctgaggacaggtcggagtttattgccagctttgatgagtatgacttgcttatcattgacgatttgggtgtagagcgcagtaccgaatatgctatggagcagatgtttttcgtcattgacagccgctatcgcagccgcagacccatgattatcacaacaaacttgaaactgtccgagctgaaaaacccgcctgatctggcccacgcccgtatctatgaccgtattttggaacggtgtgcgccgatcctctttgacgggaagaattttcgggaagaaaatgccggtgctacccgacagacagcaaaagacattgtaaacagtaagcacgactgattttttaccgggcggcacagacccgttcggagaaaggagcgccatgaacaaagaaccccgtactatgcaggtggcagacgccgttactgcgtccagagcgccggaaaacacgccggcgatggtaaagaaaatcggtaagacgacctacaaggttcatgtccatttcagcaataccagcacagaaaccatgagcgataaaatcaagcgtatgctcaaaaatgaaattcagcagatgtgacagactgataaacgaagccgccttgtgctaaactgatgatggtatgcaccaaaatttttgtcaaggaggacacaaaaatgctttacacagaaaaagagaaacatgaaattgagcgagtaaaggaagtctttgcggaacatctgcggcaaagccccgattttgaactgctctggtcggacaaggtgggctatgtctggctgacgattggcgtaaatccgctttatgtggataccggtatcaggatagaatcagccgccgatctctgcggcaggtgtttggacgatgttgctacggatgttttgtatatgacgggcaacgatcatgcactggaagcagccgacccgctggaattggccgaaatcaagcggcgctgggagtcatatatcaaccagctgccagactacgcgtatctctgcaaagacctgctgaacggaaaaatgtaatctatcaaacgaggtgtcaggagccatacaatgcttctggcaccttttttgtagattttttgtgaatttgattaaaaagtccttgacaatttgtctctggcaaaacagccaagagcattttattgagcgccgctgtccgcctttccgctttcatcctgccccagatcacccgcatcacttcgcgggacgatatggagctgggcctcatgggggagcgtaagcaggccgtgttcgccatcatcccggataacgacgggacatttaactatttggtgggtatgctctacacctgcgcctttcaggctttgtactatcaggccgacaaggtacaccagggagccctgcccgtccctgtccgcctgatgatggacgagttctgcaatgtctccctgccggatgactttggcaaactccaggccaccatgcgctcccgcaatatcatgtccaccattgtgctccaaaacatttccgccctcaaggccctgttcaaggatgattgggaggggcttttgggcaacgccgacacgctggtttatttgggtgggaatgagccctccactcacaagtatatctccgagctgctgggcaaggagaccctggacacccgcaaccgcagcgtgtcccgcggctcccacggctccagttccgtcagctaccagcagacgggccgggagttgttgacccccgatgaggtgcggaccctggataacgactatgctctgctgttcattcggggggaacgccctgtgatggacaagaagtatgacattctcaaacacccctatatcaaactgacggaggacggcggggcatcgccctacgttcaccaccccggcctgacttacacccaggccgacctgtccgtgccgtttgacagtttggattacattgaaattctggaataagagaggttgattttcatgttgaacaaaacacacaaccagtcgaataccctttctcagcggcggaccggaaaggtccgccggctctatttctccgccgtcctcatgctggccctgtgcgccgccctggcctgcccggccctggccgccgacaccgatcctcttactattgtcaacaacctcagcgactttatcttttcctgtatcaaggccatcggcgtcatcatcttaggctggggtatcgtccaactgggtatgtctatccagtcccacgacgccagccagcgcacccagggcatcctctgcgtgttcggcggcttgctcatcgctttttccaaggagattttgtccgctatcggcgtggtgtgacctgccatgcggaagtacaacaaaattatctcctgtaccgggacaccctttggagcatggaagatgatcgtacagacgccaaacgagaaaattcatgtacgctcctacttcggctattccaagcgtgaggcgatccataaggtacgggtgactgactttgacaaggaggcggggctggttttcaatcagcctccccctccaacaaagaaacgaggtgggggctgtgagcgataactgggtggtacaggctatgcaatccgcctttgagatttggaacgacaagctgaccgagatatggtccctgattaccaccacgccccaggagttccgggacggcgatatatggaacgccattgtaggcatcaatgaggggctgaaggccgtgggctacggcctgctggtgctgtttttcgccatgggaatcttccagtccgcggccagtttccgggacttgcaaaggccggaatacgccctgcgccatttcatccgctttattgccgccaaggtggcggtgagctccgccatggagatcatgaccgtggttttttccatctgcggcggtattgtccagtctgtgatgagcggaatgggcggcatggttgccgccggtgtggcggtgccccaggagatggtggacgccattgaaaacgtcggctttttagccagcatcccgctctggctggtagccatgctgggcaacctgtttatcacggtgatgtccttcatcctcattatgacggtctatggccgctttttccgcctctacatttttactgccctggccccaatccctctggcgaccttcgccggggaggggaccagtttcgcggggaaacagttcatcaagtcctatatcggcgtgtgcatggagggggccgtgatcgtactggcctgcctcattttttccgccttcatgtccagcggctccccggtcctggacaccaacttgacccccgtggtcatggcctggcagtacatcgcggagactattttcaatatgctggtgctggctggcctggtcaagggcgccgagcgcattgtaaaggaattagctggcctataaaaaagtaccatcaaattgaggggactttcggcaaaagccagggggacgggcctgcggcccatccccctgttgctttactgcctgattttgatttgcggtgtgccgtccttgacctcaaaactgatctggccattccgataccccatagcctccgccgcccggctctgctccacgatctcccgcatgatccgctgctcctccatgtgggcggtcagcctggggccgacccagcggaagatcgtcaccagcaccagaccggccaggatggcccagtacagcgccttctgctccgccacccattcggggaagatcaggttcgcgcaggcggcgtagaccagcacgggcgccagtttcagttttaccaggatgcggaataccagcaggatcaggaacacggccaggacgaaaaagaacatttgctgtgccagtgtcagattccgaaacataaaaaatcctcctctatttgttttgagatatatggtttttcctatgaatattatctcatatttcaaaaaacgtgtcaaaaaatccattttcgaggtgatagcaatatggaaatcaaaattccaaaggaagtccaccagcaccgggagacgatctttttcggcctgtccacccggcaatttctctgttccgccctggccgtgggcgcggcggtgggtgtttacttcgtgttcaaaggcgttgtgggccaggaggccgccagttggctgtgcatcctggcagccgcccccatcgctgtgaccggctttttccgctacaacggcctgacctttgagcggtttgtctgggcgtttctcaagtcccaggtcttgtgcgccgggccccgtgtgtaccgggcggagaatatctacctccaggccatgccggagcagaggaagatatggggaacaggaaaaaagccctgagcgccgggaacggctgaaagtcccctcaatttgaggggacttttgaccgctccctccatcgtgttccaatttagtccgcagcagcggcgattgatttcagcggaaaggggtgtgatgcgcggcagatttgggtgccggactggcatggcccttttctgtccattttgaaggaggtccctatgaaaaagcaatttctctcccttttcccggcctatgcggccccggtcagaaagggggcgcgccgccatgcgtaaaactcttaccgcggccaaccggggcgagcgtgttccgtttaagatcccccgcagcgtacagcagtccatccccatccagcgggtttggcaggatgggatctggcaggtcaacggcagattcagccagacctggcgctttgccgacatcaactactccctggcctcctacgaggaccagcgggatatgttcacatcctactgcggcgtcctcaacagcctgccaaccgatgccgtgaccaagatcaccattcacaaccgccgcctcaacagctccgacttccagcacagcgtcctcatgcgcgagtgcggggatgacctggacctgtaccgcctggaatacaaccgggtgcttacagagaaggcggcggccagcaacaacctcatacaggataagtacatcaccgtctccgtggcccgtaagaacgcggaggaggccagggcatttttccaccgggtagacgccgatctctcgaaaaacctggggcgtctggacagcggcgcgaaagccctggacacctatgagcgcctacgcatcctccacgacttcttccggcccggcgaggaacagttttacaagtttgacctgaacgcctccatgcgcctggggcacagcttcaaagactacatcgcccctgacggcatgaagtttctctctgaccactttgaactgggcggcaaggtgggacgggtgctgttcatgcggaagtattccagttacatcaaggacgacatgattaccagcatggccgacttcccccggacgctggtgctgtccatcgacctgctcccggtccccaccgacgaagccgtgcgggatgtgcagtctcagatcatgggcattgagagcgatattaccaggtggcagcagcggcagaacgcccgaaacaactttaccgccgtggtcccctatgagctggaacagcagagggcggagaccaaggaatttctggacgatctgagcaccagggaccagcgcatggtctatgccaatgtgaccctgctgcacatggccgacacgctggaacagctcaacgccgacacggagacccttctctccaagtccctgtgcgacttctccattctcagataccaacaggaggacggctttaacaccgccctgccctatggcctgcgctccatcgacgtgacccgcacgctgaccaccgaggccgcggcctccctcatgcccttccgtgtccaggagattcaggacatggggggcatttactgcggcgttaacgccgtcagcaaaaacctcctgatctgcaaccgcaagaatctcctcaacccccacggcttcatcctgggcgtctccggctccggcaagtccttcaccatgaaagagtttatcacctttatcgccctgtctaccaacgatgatattatcatcatcgacgccgagcgcgagtatggagacctggtgcgggccctccgggggatcgtcctggagatttccccaaacagccgccaccacatcaatcccctggagatcgccagaggctacggtatgggggaaaacccggtagcgctcaagtccgaactgctgatgagcatttgcgaacagcagatgggagagggccagttgggggctttccataaatccatcattgaccgctgcaccgccagcgtctaccacgacttcatcaagagcggcggcaaggcccgccagcccatcctctccgactggaggaacgagatcaagcgccagccggaacgggaagcccaggagctggccctggcctccgagctgttcgtggagggctccttaaatatgtttgcccatgagaccaacgtggacatagacagccggatcattgtttttgacctctacgagatgggggaccagttgaagcccaccgccctcaacgtcaccatggagaccattcaaaaccgggtagccaccaaccgtctggctgggaaatacacctgggtattcgtggatgaggtgtatttgtttttcaagtattactactccgcccaattcctctacaaggcgtggaagcggtttcgcaagtacggcgcggccctgaccgccgccacgcagaatgtggaggagtgcctgcgctccgagacagcccggctcatgtttgccaacagtgagtttctggtgttgctcaaccaggccgccacggaccgggcggaactggctaaactgctcaatatctccgaaaaccagatgggctatgtcaccaacgcggaggccggtcacggcctgctccgtgttggcggcgctatcgtcccgtttgcaaacgagttcccccggaccggggccctgtatcaactatggaacaccacgcccacagacaagtgaagtcatgtcgaaactcccctcaaattgaggggagttattttttaatgtatcgagtaaggaggagccatgccggagatcaaggaaaagcccaaggcgggcaagccgaaggacagacggaaaagcgccggtccacccaggcaggccgggcggctgatgaaagagaaactggtccgggaagtggaccagcggaaagagcgggaggccgaaaacggctcctatgctgtggatcaggtggaacaggccggagtccagggtgcggatgaatttatacaggcactccggccaaaccataagaagaaagccgacgccgggaatactcagagtgcaaaggaaaatagagacggccggccggaccgggaggccccgccccaggaacgaccggccagcgcccccaaggagcggaggccggcggaaggtcagacgccccagcggcaagggacagcccccagggagcggagcccaggcggacagcaggcggtccccatccgggagcgcccccggattgcggcaaaagagcgcgggcggggcaaggccctccagggacaagcgcgcccggatgccttgccgacggaagcgccttccgcaaaggcggggcgggagccagcccgcgggcccaggtccgccgcatatcgcggcgaggcccgccccagcgaggggggacgggccgttccaggcatccgggagccaggggcggatattcgccgccctgtcatgggcggggcaaaacccaagaccggagccccaggtacgaagggacgcgccgcgcccttgccgggaggcaaggcgcctctggggcccaaggtccggggagccgagaagcctgcccggcgatttgtccaagcattccaaaagcccgcccaggccgcccggcagtccgcccagcgccgcctggcccggcaggcagcccgcaccgcaaagggagccgccgaactgggccggaggctgacggcagcggtggtccgggccgtggccgctatgatggggagtttgatcgggctggctggcggcgccgttgttttgatcgttctcgttatcgtggtgctgatcgccgccatcgccagttccccctttgggatattcttcaccaatgagcccagcgccccggagaccgtctccgtctcacaggcggttgccgcggtcaatgtggaatacaacgccaagctggaggcgttgcaggcggggggctacgacgatattgtgatccacggccaggggccggactgggccgaggtcctggctgtgttcgccgtccatacggccgggagtgacggcggcgtggatgtggtcacgctggaccaggaccgggtggaccgtttgaaagccgtattttgggacatgacggagatcacatctaaagtggagaccatagaccatccgggcggcgaggacagcgaggggtggacagaatccatcctgcatatcaccattacccctaagaccgccgatgatatgcggaccatctatgccttcactcaggagcagaacagcgccttgacggaactcctgtccgaccgggcggccctggcctccctggccgggagcctcaccatcaccagcgccgatctgctggaggtgctccgtgccctccccgcggacctggaccaggcccggaaagaggcggtggagaccgcgctttccctggtcggaaaagtgggatatttttggggcgggaaatccctggtcatcggctgggacagccggtggggtacgctccgggaagtgaccgccgcaggcagttccaccactggcacctaccgcccctacggattggattgttccggcatgatggactgggttttctacaacatcacagacggcgaatacatcctgggccggggcggcggggccaccgcccagcactcctactgcacacctgtttccctggctgacgcgcagcccggagacctggccttctacccggacgattcccatgtggggatcgtggtgggccggagggaggacgggaaactgctgatctgccattgttccagcggacaaaacaatgtggtggtgacggagtttgccgccagcggctttaccacggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctgccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgacctttaccaccctggggcggccggatattttccagtaaacagccgaaactcccctcaatttgaggggagtttcgagctttacattttcacgcgcggcgatctggctttcactgaattgatttctttggggaattatgatacctgcacgccgatacacataacgcacaaaactgttgctaacaagacaggcaacaatttctatgtttatgttagatttagtgtgaatctatagctactatctacaagaaccttgtcagaagtaattggggaaaatgggttctgtattgcatatccaataatttcgtacattcctggctcgtttggtagagcgatttcgatttctccataagcggttcctgcattaccatcaagcgaaagcgcatagtaatttttcccattgattttagcttgagaaaaatttatagttattatcaatagtgtatttgatgcttcgctcttgtctaaaaaatacattagcttgaagggagttccttgtttatgttcaattagaggctctggtctcaaaattccgtcattttcaatcaattctttggctccataatcggtgtttagcgttaatggactgaagctatccatatgattcccgtcaggaataaaataatcgtgttgcttttcggattcaaatacaggctccatagaagataagctataaactagatcataaactgcattagcgccataaaagttagttaccctatcatattcagcggcgtggtgatttggagaaactgtaaaagtaacaaaaagtttgtggagagcatcatctctatttagctgttcttcatctaaaaatacaggtatagtaactttcatactatctgtagcatcgaaagtataactctcaacgtagtttttgccatctatagaaaatttaattggcacataatcataatagagcaccataatgacttgagtactgctacctacttcggcaaattcaagatatatcggattgttagcatcagataagaaaatagtattcttttctttaagttgatctgtagaattatcattgtatacatcaatataatagctattttcaaattcaggatgtaaattttcaaatggtgtttctttaatgagttctgatgtattagtatgggaattagagctatctatatgtaacaaatatacaagaaagactatacctacaaataaaagaaatgcggtaggaactattgctgcgcggagggtagtagagcgagaattaagtccatttatcttactatgtctcatcttaccggaatcctttcagcaaatgtttattagaaagcacatatcatgcacaaataatgtgcatgatatgtgctttctattactcaaaaaccaacatcatttctgatctagaaactaaccgatacagattatttaaacagcggggagtcctcgttgccatactgatatccagaagaggatgtatctcttatctttcctgatacaaaatactggcggtaggggccattttcataaatcttgtcagttaccacggattccttattgtagccagaagcggtatcgctggggccatcggcatcgccattactgtatgtggcatagacttttacatacatgtaatatgcagtaccggcataggtgttcattgatccttcgccccatgcaccgtttggatcataccgaattttaacgtatccccacgaagcccgctcattaccaacggttgcggaagtttcagatatcgcatctgattcaactgcggacgcgccaaccacgcacatagaaagggccaatacaagtaccatgatcatagaaatagctcttttcataatgatactccttttaaaatatagactttggatgcgttgattcggaaaactcacaaaaataacactaaaccaagggagacaccttctttcctaaaaacattatggtatgctaagggttgactttttaagcgcttctacttatatatgaccgggcataacaagttctgacataattccaagaaaattttgggtcaatcataaacattgtgggatgaaggattcctgatgtaaggctttcggctgacatcgaagagcttgaggaagaagtaatcatcgtctggatagccataacccttgcgccgcagggtcttgattttgttgttgatcccttcgatcctgccggcagagatgttgaaggtggcatgggcgataatgccctcaaaatgctcgtccagaatacggcggaaaatgactcctttagaagattgtggtggagaggcgaaacggtaggaagtcactgctccgccattgttccagcggttagaacaacgtggtagtgccagagtatgcacctaacggatttattgatcttgaacagttgtactacaaatcatgaagaaagaacaacaaatcttcattttctaaaaaagatatataggtcgcattgtggatatagtacttaatggccaacacatctcacctcatcaacatttgtcaaggatgatcctaatatgtactcagttactttttgtgacttgctttggtgtcctccactgtatacaactggcaagaaaggttacacccatgatagttaagaaaccgtgtaccgtaggatcgaataatgagatagagataagtatatagagcgaatctggattactgggagacataaattcggaaatagacataattaggtgtgacataggtaagcaattgtatattctggccatcgatagcgcaaaaatgaaaaatgttatagcaatccaagtaactatgtatggcagtaaagtcaccaataggcttttaatttcaagatgggcagaatacagtttcccccgcaataacaatcccgccaaaactcctgcaactatcgaaacaacagcctgtatgagtagccaaacatacggagacagatcaaatggtagcatcaatagcctagtcgcaaatagaacggaccaactgatacacccaaaaatgattgtcctgataatcggagctacaagtttcatagtactataattctcctgagtaacttacgagaatattgaactggttacaataaggtagaggattccattcttttcgcactttatcgatgtttgtacgcctagagtatatccggtaatgtcatcagcatagtaatcaaaagacatggcgttaggatgcttagctacacaactatcgccagggacatttgcggggaactccccgtaaagtactccagcactttcgggattggcagtgtcatacaaagagttgatccactcgcctttaacccggtacagctcattaactgggccaagattatctatccagtagagggttgcgtttgcctgtactttgcggccaccacctgcggaaccctcttctttcttagtggaggctttgacttcatatagtgttccacctccggcagctctagtaagtgtaccaagtttttgaatttgaagatctacatctaccggagtctgcgtgccatcgtcctgctcgtatacagcggatgcctgaataaagggaagaacttctgaggtatttatggattcagcttctaaaacatgactgtctgtcttggcgataagggcgtctatttcagcttggcgtgcgtcagtcggttgatacgacgctccgacttgaaacatggttgtagataccaggactgccaaacaaaccagcacactaaaaattcgctttttcatgacttgttacccgtcctttcaaataaacacaactttcacttggtatggtgacttaagagacatttgagtcctctctatacataagcatagatgcctagacccaataaatataaacgtattgtgattatcactcctcataagtaggttatagtattaaaccttggcatatcccctccccatagacaagataaaatatccttaaaagatacctttatttatatatgaccccaaatagtttgttctgacataatttcgcaaattttattagttaatagaaatggaactaatggtgcttcgactagagtgagtttgggcaatataattttaccaaacaggaggatggtagtatggcccacaaaatactggaagaaatcatcggcaaaaatattgcaaggtaccgcgaagcggccgggctgacacaggcaacgctggccgaaaaaatcgggatcagcaccgcctttgtctcaagagtggagcggggtcagaagaaaatgaaggtagagacgctctatgccacagcaaaggtcctcaatgtaagtgttgatgccctattgagcacggaaagctccgcggcacagttggcaaacatcaaccagcttctggcgggccagtccgatgagtatttggagggaatcgagagaatgatccgggtctgcattgaggagtttgagccgaaggaaaaattcccatcgggatcgtaatatgatatactaaagacgatgggaagtgattgctgctatgatgcctgataaaaatgagctggtcgagcgtctataccgcttgcacttcaaaaaattatttatatacgccaatgctgtgctcagagatccagagcaggcaaaggacgtagttcaggataccttccatgaagcactacgccgtattgatgtgttttcaaagcatgaaaaccccggcggctggctgatgaacaccctaaaaaataagctcaaagaaaacgaacgaactagaaggagagatctcctccgtctgctctccctggatgccgatttcccggatgagagtaacctcccggaggaacttgtggccgcgcagcctgagccgcaggaggagtctgtaatagagaaggtcgaaaggatacttacgccggaggaatatcaacttctgaaacgactagtgtttgaccgtgccagtcacctggaggtggcacaggagtttggcatatctgtgtacgccagtcagaaacgcctggagcgaatcagggctaagctctatacggtatttcctgagcgaaaagggcgaaggaaaaaagtttgaaacaaagcgatagccgaagcagaaggaaaaagggcgcaaaaacacagccgcagggactgcgggaaaaaacgatatggaagagggtctcaacctgactcgacgtccagttcgtccttgaaaatatagccccgcttgcgaagtagagccaggccctccgccttggaaataacaacggaatgctccgtcagcttgtcggcaagataaccctttgcggaataaggctccagcttggacaggatgttccagatagcggtcagaagcatccggcatacagcgataatcgctttcttgtgcccacggcgggctttgattctgcggtagcgttccctgcattcagggtgcctgtcggattttatgacggcatttgctatttgaaccagcagaggcttcaaatagcagccagctctggagattcgtgtggacttcactttcttattgctctggtcatttcgaggacagcatccagcccaggaagccaggtgctttgcagagggaaataccgacatatcaacgccgatctcggagataagggccacagccgtcagcggagcggcggcaaagccaggaaccgtgcggatcaattccaactggtaaggatagggctcagcaagccggaggatttcagcttcgatacgctccctgtgcgcattcagttggtcgatgtgcagcaggcattccttgagtttggctgcctgttcacgggataccaccccgtccacagcagcttggatttcctcaacaggatgcttgcagcgccggtggataaacggagtcacatcaaactgctcaccaggatgctccaaaatgtactggataatggagcgtgaggattttccaaacacgtcagaaaacacatcatccagcttcagattggaaacggtgaggcagttttgggcgcggttcttctctccggtcagcatattggtgagcttcacacggtagcgcatcaggtcacggagctggcggatgtccggcggtgggataaagctgggcttgaccatgccgcacatatacaggtcgcaaatccacttggcgtccttgcggtcggttttgttgcccttctgcggtttcgtgtatttcgggtgcgccaaggtgacccaacaggtcttttcaaggatattgaatacaggaatccagtatttccctgtggattccatgcagacatccgagcaggagtatttcgcaagccagtcagccagatccctcagtccgttggaaaacgaggaaaagcgagcctgcttgtactctgtccggccattggaatccgtgataccgatacaggcaaatatccaggttttgtgaatgtccagtccacagcagtttttgcggagaattttgaaagccatttgcctccctccagacacagtgtttggggaggttcggcagggactggccacccggcaaaatcgagtcgatttgaaagagataagtttacgggctgctgtcatgcgccattcgttgatgccttaacgggtggccgaaccatatagaaatgcggggttgccgttatacagccccgccactcacctccacggtctctgtagtataccgagcactcccgtgaacagtatagcaaacatcaatttcagacgaaagcacctgcgtttcataaccccgtctgtgcctttcgcagaaaggcggattatagaaatgaaaaagtttgtcaggatttgccttaaacgttcatatatatgtgaaggaggttcacgacatggctaagaacgatgaaaaatacgcctatctgaaccggcttagtaccgagcagctagaggaattgctgcgcatggatatggagatggcagagccagggaatgaggacgtggtttttcatatcctggaggtgattgaacagagagaggatgagcaccccacgggacgcatccctgatgtagacaaggcgtgggcggagtttcaggagtattacaatgtcccggagggagctgatgactctctatacccctgtaaaaccgagactggcaacagttccgagaatccagccaagtttccttctcctcgcacgccccgcctgcaccgctggattaaacagggccttgtcgcggtgatcgctgtagccgctgtatttggcgggatggtcgcggcccaagcggcgggaattgatgtgttcggtacgattggacgctggacagataacgtgttccgctttatgccgtcaggaaatgagaatagcacgtccacgggtgccaacgcaggtgaagatatatcgaaatatgccactctgcgagaggcactcgcttctgttgggattgatgaaaatctggctcctacatggtgtccagacgggtttacagcgtcggagccagaaaccgtcaattcatcagtgggaaacgccgtttattttattttgagcggcagggatggcgaatttattagcctggattttattagatatcattcgagggggaatttagaagagacactgtttgaaaaagatgtcaagggagtagaacagtattctaatggagaacaaaccttctatattctgtcaaacatcgacactattacggctacttggtcagatgggctcataatggcacagttctctggagatacaactgaagatattctaaagaaattgattgattctgttggagggagataaattgaaacggatcttttcatcttttgtactgctgagcatgattatctcttgcgttggcgttgcttctgcggctgatatgcagcaaccccgagcaagtctcactctttccagatattctgcggtgatttctgctggagatgggagcggcgaggttatcattggctatgatgtaaaagcaagtaagccagccgattctgttggtgtagagtctattgaattttacacggaagatggtaagcatgttaaatctgttactggtagcaccagaaatggcttagtccgtaatgacagcattttttgtgccggggactacaaatgcagtctcccttctggtgaggcttactatgccgaagtgaccgtctttgcagaagtcggttctgactatgatagtcgcacgattactacatcgacaatccaagtccactaacttcagccataatattttgcgtatcggggtggtagacaacatcccggcgctcttatttttagcgttaaaaaagtcccctcaatttgaggggactttttctatacaaaattaaacgtggattgcaacaaaggtgggggaatccagaaattcatgggttccagagtttcgacaccgctcgtccacggacaaccattccacgtcggtgattgtacttgagtatccccacactgatgcaccttttcccggtataatagagacaaatcaagtagggggtgcttttgtgcgagaaaaactagtcgcaaagtgctatctttgtgcaaagacggcggggccgctgaccttggagtattatctgctggtaagtccgcttgtggaagagttggagatctacggtgttaaaattgttgagaagcggagtggagtagtcgctatcgctcccggtctcacaacgagcggtcggaaaatccttcacctgattgacctactttccaaagggactgttacgccaacaagtctggctgatattgtggaggattggttataagctatggaatctatctgtttagatgccctcgctttcacctagaaaggacggtatcaaatgccaatcttctactttgtacctgaccgggaggccgacaccttcaaaatgcccttgactgcggagcgcctgctgcgcagcctgggcaccaccgggaagctggccggcttccgctgcaccgtctacatggttgagcgcatccaggaggatcccgaacagctccagttgattacaaagcggctctataaagaaaccggaaagaagttcggagtttcggcggcatcggttgagcgcaatctcagaactctgattcatttctgttggagccggacagatcacagctttttagcgcatattgcgggaacggacttgagaaccccgcctacaaacagcgaatttctcgacatgcttgccagctatttgcgagaaatgggtggctgaaaagaggggaggcattggcctcccctctttctatgtcgatggaagttgacccaatgcggtctatgctgattgcagtcggccattatcgacaggaatggactgtattttgacagagttcgctccactttttatcaaaaacaagcacaatgagcaaagaaagcagcttgttggaaaatgatgatcttcctaaaatgcacatcaaaatgaggggactttcgacaccgacgccaatcggcacaagcccgccgcctttccggcgggcctgtgcgggctggcgacagttcgataattgaataggtccactgggtacgtccgatatgcgtccgagaggaaagccgtgcgggaatgagcaggccatgaccccactttgagaagggaggtatagggagagcagccatccgcgcacaaacaggccgtggcgggcctgggggcgatgatccgcatatcggggagatacgattgtccagtctcagtccgagcgttgaagcggtccaaagaggccgtgagccgtcgcaggcaaagagggcaacctgcgagacccgcagggggtgaaattcccgtgtaaggcgtgccagcgccgtccagtgtgttcctgaaacccgttccaactcattatcacgataccaagagccgcacctgcatgagggggcggtttttgtcatattatgcgaaactatggaggattgcactatggaaaagaaagttcagcttcccaaagaagcgcagccctggacggaggtagaggtactttttatcgacggttgcaaagttacggtgcggtacagtagacagaaaaacccgtctgctgtcaaggtgattaaagaaactcttttagtcagcggaactactcgaaaaatctgattttttgcatattttgcttaaatatgagataataatggtgtaaatggcaccttgaaaacaaaatattccggccgccatatatacaccattctcagaaagcgagaggtatatatggctgaaaaaatcatgcaaggcataaagcagatttctgagttgatcggacaggctgtcaaaaagcgtgtggtgtgcctttaccgtgtatccacggtaggccaggtggaaaaggacgacattcccatgcagaagcagtattgccgggagttttgccgtgggcaatccggctgggagatcgtgaaagaattttccgaaaaaggagtttccggcttcaaagtctccgccaaggacagagacgcaatacaggaaattcaaaaaatggccttgaaaggcgagtttgatattctgctggttttcatgtttgaccgcctgggccgccgggacgatgaaacgccttttgtcgtggagtggtttgtcaagcagggcattgaagtctggagcgccatggaaggtcagcagcgttttgacacccatgtggataaactcctgaactatatccgttactggcaagcctccggggagagcatcaagacctccctgcgggtaaaaacccggctggaacagttgacccaggaagggtattataccggcgggcgcgtaccgtttggctatcaggcggtgaagcggggccgaatcaacaagaaaaatcacgaggtccgcgatcttgccattgagcccggagaggcggaggttatgaaaatcatcttccaaaaatacgtctatgaagggtacggggcgctgagactgcaccgctatttaatggatcagggcctccgcacgaaagacggcaagacaatcacaatgggtatcatcaaccgggtcattaaaaaccctatctgtattggaatcatccaaaagggagaaagccagtcgagcgtactgcccgaactcaaaatcattgacgaggaagtgttcgccagggctcaggagattgtgcgtgagcgggtagtccctcaaagcgaggttcctcttacgaccagagggcagtcccttctggtggggaatgtctactgtgggcattgtggcgcacggctcttactggctatccgacaagctctttgagcattgcgccgagattgacgaagcggcacgaaaccgcatggagctgatcgtgcggtcactggcagagcaaaacggcgtgaccgagcaactgaaagctgaaaaccaaatggaatgggtgcggcagatgaacgcttgcaaggcgcaggcagaggaagttgtgaaagcagagttgatttataattgagcgaggaagtccgggcagaaaactgttcggacttttctcatatagtccaaagttgcggtagaattgttcacaagttttatggtataatttgaatacgaaattgagcaacaaatcggaagttcaatgtgaggaaaattagatgaagaaaaagtcttattggttaagtattagtgtgttcgtattgatactgatatggacggtttattattatgcaatgcagtacacaggaggatttgcagacttaaaggactctattgtttgtgggattgcaggtttgatatgtatcgtatttatcgtgaaaagaactattgactttttgaaaaacaaaaaatcgtaaaatttcagtttgtcgcactgataaaacccctttaggaactaaagggcgcacttctatactctctgtcgagagtagtgcgtcctgcggagcttcattctccgtcagcagaagaaaactgcatgaccgagaatgttgcgtcacttcgttccgtcaaggtggctacacccccttgcgccgctaaagcggctatcccctgtggacttgccgtccgcaaacggttttgacaaaccgttcgccgccagcaagtttgaaaatcaagaatcttaatttgataaaggagtgtgattctatgaaaaagaaattacccataatcctcttgggtgttattttggcttgtgtgttggttttcggtttcctttatgcaaacaatgacattggtaaaaccgcaaacagtttagaagcagacattcgccaatctcaaaaaattttggatgattggattgttgatggaagcatttccgacacaatggctgcatttatttcttacccacaggacaagacagaccacactttttctgtctatgtaaatcgccctggcttgtcttttggatatttcttccgtggtggtggagatatagttgaggttgatgattacattgcagagtttgttgttgagggaaataacgaaagggcatttatctcaatgaatacccaaaatattgttcgacttgaagtagatgatggcaacggcattcaggtgattgatattgatagtggcaagcctttcgccattgtcctgcccctcaatgtaggaaacatctgtttctatgatacgaatggaaatgttgtggaatatcttcgccaacaactttgaccaacttcaatttaccgaactgaacacaacaactgaataccgaaaaactgaccgttgactggtcgcaatctgcgaaaagttgacggtctttttttatccccattttcaaaaaaggaggtcacgaaaaatggcaaaaccgaaaaaccttgaacagctccgagccgaaaaggaacaggtcgagacacagcttgcacaggaacagcacaagctggagcgtctggagaacagaaagaagtatctggagaaaggcgagagacaaaagcgcacccaccgtctttgcaatctgggcggcacgattgagagccttgccccggagttcaaagatctcacacgcaccgaaatgacggagctgatggagtacatcttttctctgcccgaagtccagcgagccgtccgtcacatggcgattacccacatcaaccaagcgagcagaggaaaggagcagaaagccgatggcactatttcatctgagcgtcacgcagactaaacgaagcgcaggacagtccgctatcgcttctgctgcctaccgttccggcgaaaagctgtatagcgagtattacggcgaatatagcgactacaccagaaagggcggcgtgatctgctctgacattctcttgccgtcccatgtaccgccagaatacgcagaccgccagaccctatggaacgccgtggaaaaagccgagcgtggaaagaacgcccaacttgcatacagctttgacattgccttgcagaatgaattttcccttgaggaaaacatcgctcttgcaaggcaatttttattggagcagtttgtgagccgtggcatggtggttgacttcgctgtacaccagccagacagagaggacggcggcatacccaatccacattttcatgtgctttgccccatccgtcccatcgagcagaacggcaaatggggctgtaagcagcaccgagtttacgagctggacgaggacggcaaccgtatccgggacgcagacggagagtttgttttcaatgccgttcccactaccgactggggcagtcccgaaacgctggaatactggcggcagacatgggcggagctatgcaatgccaagtttgcggaaaaaggtattgatgttcgtatcgaccaccggagctatgagcgtcagggcgtggagcttcttcccaccgtccacgagggcgcaaccgtccgggcaatggagaagaaaggcatacgcaccgagaaaggcgagttcaaccgctggatcaaagccaccaatgccgttatccgtgacatcaagaagaaaatcactctcctgtttgattggattgccgaagcaaaagcggagcttgccaagccgcaggcacccgaccttgtttctctgctgaacgcctattacaccagccgcagagccggggcgtattcgcagaaaggcaaggtcagcaatctaaaggagatgaacgagactttcaattatctccgggcaaacggcatttactcccttgaagatttggaaagccgtgtcagcgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaagcggaactgatacagttctacgccgccagacgaaagctgaccggggagttcccggacggcaaggtggatatgaaaaagctgtccgacgagtatgacgagctggaacaggcgcacgaaaccacctagagacacgccactgacccttgccgatgagcgcatagcaagggcaatccgtgagaacaacgcaaggctggttatcattgacccggtgcaggcgtttctgggcgcagatgtggacatgaaccgggcaaatgaagtgcgcccgatattccgcagtctgggagacattgcacaggctaccgggtgcgctatcgtgctgatcggacacctcaacaaagccgcaggaacgcaaagcacctaccggggattagggtctatcgacattacggcggcagtccgcagtctgctctttattggcaagctgagggacagccccacaacaagggtacttatccatgagaaaagctcccttgcgccgcccggacagtcccttgccttttctctgggagacgagaaaggctttgagtggataggggcttatgacattaccgctgacgagcttcttgccgggacagacaccgcaaagaccgagagcaagaccgcacaggcgcaaatgctcattctggaattgcttgcaaacggaaagcgtatgccgagtgcagagctggaaaaggcagtcaatgagcgtgggatttcctcacgcaccatgagaacggcaaagagccgtatcggagacaggcttgtgaccgagaaagacagcacagcatgggtctgctatctccgagactgacaacaggaacacggcaagcgtggcaaagacggcaaggtttttatagataccttaatgttgccgccttgccttgttccctcataccgacaccgcccgatgatgaatagttaccgggcactttttcatttacaggaggattttgaatgaacaataccgcaaccaacaccaccacttgcccgactgtcagaaagcagattggcaagaccacctatatcgtccgtgtccatttcagcgagaccgccaaggagacgatggaggacaaaatcaagcgtatgctccgtgaagaagtccgcaaaatgtgacttctttttgaatttgatgaaaaagtccttgacttttcgtctctggcaagacctccaagtccatcctcgtgtccaccgccgtccggctggcccccttcaacctgccccagatcaaggccatcaccgaccacgacgacatggatctctacaccctgggcgagaagaaatgcgccctgtatgccgttatcccggataacgataccagctttaattttctggtatccctgctctacgcccaggcgttccaggccctctactacagcgcggaccagatccaccatggggccctgccccgccatgtccactttgtgctggacgagttcgccgcgatgcccctgcccggctttacccgtgagctggccaccatgcgctcccgcaacatttccgccagcaccatcatccagaacatggctcagatcaaggagctgtacaaggacagctgggagaccattcccggcaactcggacaccatcctctacctaggcggcaacgaggccagcacccacaagtacatctccgaggcgctgggcaaggccaccattgacacgaggacccacggccagacgaaaggccgctccggttcctactccaccaatttccagatgagcggccgggagctgctcaccccggatgaagtgcgcggcctggacaaccggtatgccatcctgttcatccgcggcgccaggccggtcatggatctgaagtacgagctcacccagcacccggccatccgccacaccgtggacggcggcgggccgccctatattcataaagggaaacaagcgccagcgtttacaggaactcctctttttcaggcattttccgctgaagaactcaatgaaagcgaggagaatgctgcatgaaacatgatcttaactgcaacctccagcggcgggcaaagcggctttacgccctgtttgcctgcctcgtcctgaccctgcccttcgccgtcgtccccgcctttgcggcggatgaccctctgtccgtggtcaccagcctgtccgacttcatcttttccctcatccgggccgtgggcctcatcctgctgggttacggcatcctccaggtgggcctctccctccagtcccacgacccctcccagcgctccaacggtatcctcaccatcgcgggcggcattgtaataacttttacgaaggagatcctcactctcatcaccgggggataacaagcagccgggatcgcaaatgcgttcccggccactcatcttcacaaaatgttttgatagttccgccgcccatagaggatgcgctggatctgcaccatttgtcctgagatggtataaaagaccagataattctccacgatgagatagcggtatcctttggcggccagggccagatcacgggggcgcggacaccgttccggcatatgagacaggccgccgatctcctccgtcagcttgtcatagtaccgcagagcggtctctggggagagcgtgttcagatagtcgatgatctccagaagatcctgctttgcggtggaaaagatttttacctcatacttttccatggacgcgctccctcagctgacgggccactgcaaggaaatcttccccctccgcgccggcggatatctcctgctccgccacggccagctttccgtaaaggtcgatgagcgcctgctgccgctcatactcctccatactgaggactaccatgtcgccgctgccgttgcgggtgatatagaccggctcatgggtctggcggcaaaaatcagatatctcgttggcattgttgcgcaggtcggaaatcggacgaatggtcggcatgacagccacctccttataggaacagtatagcaaaattatgagtaaatatcaaataaaatttagagtgaatcgaggtgatcaaaatcggcagtggaaactggatcgtcgacaacttaaattccgctctggagacctggaacggcaagctcacggagatctggcagctcatcagcactacaccggaggagttcaagggcggcggggtctggaatgtgattgtcaatatcaacggcgcactccaagccatcggctatgccctcctggtgctgttttttgtgatgggcgtggtcaagacctgcggcagctttaccgagctgaagaagccggaaatggccttcaaatgctttgtccgttttattctggcccaagccgcggtaatgtatgggatggagctcatgactgccctgttccgtgttgcccagggcatggtctccaccatcatggactcgtctggcctggcggatctaagcgccaccacactgccggacgagatggtggccatcattgagagcgtggggttgatcgagagcatccccctgtgggccatcactctgctgggctccctgtttatctgggtgctggccctggtcatgattctgaccgtctacagccgttttttcaaactctatattgcgacggctatcgcacctgtaccgctggccagctttgcaggacagccctccagcagcatcggcgtggcctttttgaaaagctacaccgccatctgcctggagggctgtgtgattgtattggcctgtgtgattttctccgccttcgcctcgaccccgcccgccatagcggacagctctctcgctccagccaccattgtgtggaactatgtgggcgaactgattttcaatatgctggttctggtgggctccattaagatgagcgaccggctcatccgggagctgatgggcctgtaaatattacagaccctccgtttccactacggagctccctgccgctctggcctgccgcacacgctgtgcaagccgcttcgctgcggcgtgctcagccagtgcatcccccagaacttcagccgccttccgcaccagcatcaccacccaagagagggcggctgcgccgaccaggaggagaaggatgccgtccgccagcgccgtgtgggcctgataccagccgtggaacacggtgagcatcagcagcacatacacaagcgggattcccagccggagccggattgccagactcagcagtaagagcaggaggcacagccccgccccaagcatcaaaaccaccatcgccacaacctcccttttttgtttgtggcatattagcatagacagacaacttttgcaaccgtctgtctgccaattcttaaaaccggaggtgagttcactggaggtacgcatcaacaaggaagtacgggactatcaggagagcttgttttttggcctcaccctgcggcagtttattttcgccctgctggccgtcgccgtggccgtgggcatctacttcggcctgcgcccggtgctgggcagcgaggttggctgggtgtgtgtcctggccgcctttccctttgccctgggcggcttttttcagtataacagcatgacctttgaacagtttatcctggctgtgatccgctccgagctgctctatccgaagcggctcgtattcaaatcggaccacctgtatgccaaagccttggaaaattcaacgctgaaggaggctctcaagcttgattaaaaccctgctgaccacgttaaagcaggacaaagagacattcgaggtgccgaaatccgtacaggacgccatccccatccgccgcctctggccggatgggatttttcaattcggaaacaaattctccaagaccctgcggttcagcgacatcaactacgccatcgcatccaaagaggacaagacggccatgttcctggactactccgagctgctcaacgcgctggatgctgggtccaccaccaagatcaccatcaacaataagcgggtcaaccgggaggactttgaacgggagatcctgctgccccggcaggatgacgcgctggacggctaccgggccgagtacaacgccatgctcatggacaaggtcaccgactcctccaacagcgtggcccaggagcggtatatcaccctgtccgtccaccgcaagagcgtggaagaggcccgcaccttctttgaccgggtggtacacgatgtgacctcccggctgaatcatctggactcccacagcgaggagctggacacggtggagcgcctgcgggtgctccacgacttctaccgcgccggcgaggagccggagtaccgcctggatctgcgggagtgtatgcgccgcggccactccttcaaggacgctgtctgcccggacagcctggaatttaagaaggaccacttcgtcatggggaacaagtatggccgggtgctgttcctcaaggagtacgccagctacatcaaggactccatgatcaacgagctgaccggcctgaaccggaacctgatgctgtccatcgacatcatccccgtcccaaccgacgaggccgtgcgggagctgcagaaccgcctgctgggggtggagaccaatgtgaccaactggcagcgccggcagaacagcaacaacaacttctccgccattgttccctatgacctggagcagcagcggaaggagacccgcgagatgctggacgacctgaccacccgtgaccagcggatgctgttcgcggtggtgacgctggtgcatctggcggacagtaagaaggagctggacagcgacacagaggccctccagtccatcgtccggaaacacctgtgccagctcgcccctctgagctggcagcaggcggacggcctcgtcacggctctgcccctgggcctgcggcggatcagcgccctgcgcaccctcaccaccgaggccctggccgtcctcatgcccttcaaggcccaggagatccgccaccagggcggcgtgtactacgggcagaatgtcatcagccggaacctcatcctggccaaccggaaggagctgctcaacggcaacgggtttgtcctgggcgtctccggctccggcaagtccttcaccgccaagcgggagctggcggcgctggccctggccaccggcgacgatattatttgtatcgacccggaatcggagtaccggcccatcattgaagggctgggcggcgaggtggtcaatatctccgcgacttcgcccaaccacatcaacgccatggacatggagcagggctacggcgacggggagaacccggtggtgctcaagtctgagttccttctctcgctgtgtgagcagctcatgggcagccgccagctctccgccaaggagaagtccattatcgaccgctgcacggcccagtgctaccacggctacatccggggcgggtaccagggcagcgtccccaccctgcggaatttccacgcggagctgctccgacagccggagccagaggcccgcgacgtggccctggccattgagctgttcaccgagggcagtctgaataccttcgccaagcccaccaatgtggacaccaattcccgcatcctctgttatgacatccgggatctgggcaagcagctcctccccgtggggatgctggtggtgctggacagcgtgttcaaccgcatcatccgcaaccgcaggctgggcaggagcacctgggtctatattgatgagatctatttgctgttccagcatgagtacagcgccaacttcctcttcaccctctggaagcgggtacggaagtacggggcctgctgcaccggcctgacccagaatgtggacgacctgctccagtcccatacggcccgcaccatgctggccaacagcgaattcctggtcatgctcaaccaggcgagcacagaccgggcagagctggcccgcctgctcaatatctcggacaaccagctttcctacatcaccaatgtggactttggccgggggctcatcaagtgcggcagcgccatcgtgccctttatggaccatttccccaagaataacctctaccggctcatgagtacgaagccctccgaagcagatgcggcggtataatgtagaaggggcggggccctcctgggccctgccccctcttcgcgggaggtgatactccattgaaacgataaaagaaaaacccacggtacagaagcagctcaaggagaagatacaggcggcgcccaaggagctggcccggcgcgggctggaggacggcgtcgagcggctgagggggcagctccgggataccgcccagggcggccaggcagaccgctatggcggcgaccagattgaggatgccgcggccagtggagtgcgccaggcggagcaccgtgtggaacggctgcttggaaaaggtaaaaagaagcgcggcgggtcctccgtcgacgttgccccaaatgagccgcctgccccggcagaggacaccccagcgcacctctctgccgaacagcggccacgaatcaagacacgggaggcagtcaggccctcttcggccactccggcgcaaggacagcccgcacagacggcctccaagcctgccgtcaaaacgaagggaacctatctccaaggggaatccgcccctcccactgaaccgccctcccaagctgggcaggtggctgtgcgggaacagggccggatcgcggccagggatcgggcaccgcagcgacaccggccagaatccgtatccgtgccccggagcggcggcggtcctgcttcgacccagaatgctggcgggaaagctgggaggagcagctacgcttcaccgggcccatcctacacatcaggagcgcctgcgcgtcggatatctcaaggacataccgttccaggaaagggcctgtccgtatcaaagggagatccacgccctccgcgcggcgcggtaaagaccgcggagcacacctccaggcggaccatcaagacggcgggtcaggcggctaaaacggcggagcggacggcaagagccgcccccggaaccatgcgggccgccgcagacctcacccggcacaccgcccaggctgtccgcgccacggcccagacagcggctgtaactgccaaagcagcagccagatccgccgtggcagcggccaaggccgtcattgccgccgctcaggcgttgctctccgccctcgcggcgggcggcggggtcgttcttgcgctcgtagtcgtggtgtgcctggtcggaatcttgatcgtctcgcccttcggcatctttttcgcggacggcgggaacgccccggacgccgtctctccatctgcagccgtggcccagctcaaccgtgagctggcagaccggctggaggagctgcagtccggcggggtatacgacggcgtggaggtgcatggccagcctcccggctggccggaagtattggccgtgtttgccgcccggacagccggagcggcggatggcgtggatgtggcggtactggacccggagcgggtggaccgcctgcggacggtgttctgggatatgacaaagatcaccacccaagtagagaccatagaacacacaggaaccagagaggacggaggatggacggagtccatcctgcacatcaccatcacccccaggacgccggacgatatgcgggtgttctatcaattcactgatgaccaaaatgaggcgctggacgagcttctggaaaaccgggatctcctggccgcactggcgggcgacttgacgatctccgacccggacgccaaggccctgctggccgcgctcccggaggagctgtccccagagcggcgggctgtggtggagaccgcctgctccctggtgggcaaggtgaactacttttggggcggcaaatccctggtttttggctgggatgagcgatggggaaccattcagaaggtcacggcggcgggcagctccaccaccggaacctaccggccctacgggatggattgcagtggatttgtcgattgggtattctacaatgtgacaggcggggagtacatcataggccacgggggtggggccaccatgcagcacaattactgtacggaaatctcctgggacgaggcccttcctggggatctggtcttctacccaggcgacgagcatgtgggtatcgtgggcggcagggacgagaacggagagctactcattgtccactgcgcgttcagccaggataatgtggtcattaccgaaaagagtgggtttgtgtcgattgcgcggcccaactattacagcgaatagcatccgggcgggggcatgatccatgcctccgcccatttcttaagtaatgttcgcataaagcagggtgtggcacttctgctcatatacctctataatattagtccgtgcgcatatcatgacaaagtcttgtaaccctatcaagactaatgtatgattataagtaggacgagtctgatgagactatgaggtaacaaaggatggcttacacatacaaggtctggattgtagacggtaaagaacattttgagtatggaaatgggcagacaaggaaaaaagactttccttttgcggaaagtctgatgaaactgctctatttagatatctggtcattcgcggatttgttcgagggcatgggcaagtcgattgtgaagctgtatgaaaccaaggagcagcagtattccgacaacgtgttgtctgcactgaacaccgtagcaaaaaagcacatctattttgaactgctgcgccttgactggtgggagcgtttggaaaaagccaaggcacagggctacaaggatattgtggtcttgctaccaagaaaaaagctgccccatactccagcgaacattcacaccatgcagaagcagatgaaggcgctctttgcgcaggtgttggatctggatttaagtccaaaggagtcggtgcagcaaaagatggtgcagtactataataatcgcggtggtgaccagttgaacacctttcagtttcagccccaggccatgagctttgagatcattggccccaaaacctttaccgaggtgctgtatcccaaggatatttacgatatcatagactactttgtccgtgagttcgtgaagcgtaagcagccgattcgcctttgcaaaaactgcggacggtactttgctgtttccgggcgtatcaacacagaatactgtgaccgccctactgatgataaaggccgcacgtgtaaggatatgggcgcgaccaatgtctggggacagaaaagcggaaagatgatgaggtgttcaaggtctaccgccgagaatacaaaaaacgctttggctggattaaggcgggaaaaatcgagaagtatgctttctatgcttggagtaaaaaagccagagaagaaaaaacgaagtgtgatgccggagggagtagcttgcaggagtttaccaagtggctgaaggaatcttgatttttacagataagtgtcacagggaggagggggacagatgctgatttatctactcacacttatagataatgaaggtgaccgtcaaacattcacggctatttatcaggagtaccatgtccaaatggagaaggttgccctgcggattctatcggaacataatgatgcggaggatgctgtgcagaatgcgtggatacaggtaatcaaacattttcacaaggtttctgaaattccctgcgaggaattgctcttttggctcatttccattacgaagaacgaagcgctgatgattctccgaaagaggcgaaaaaccgttcccttagaaaactgggatgcaaccacagaagtctggaatcacgatatgaattatcaagagattgtggcgctctttacacgactgcctgaaacatatcgggttacattggaaatgaagtttttgttgcagtacacagaccatgaaattgcacaacatctcggtatcagcgaaacggcagttagcacccgcgttaatcgggggaggactttgcttcgtgaactcgctataaaggagggactacatctatgacggatgaaaatttggataaattgatgcgcaaagttcttatagatgcactgcgtatggagtggtctgatgctttaaatgagagtccaactatgagtactacaaaggaatttcaacatcagatgaaagtgatgcttagagatccctttgcatggtatcataaaaagactcgtcccttgtggaaaaaagtacttcaaacggttgctaccgttgtccttgtaatctctctgtcctttggcacgctgatggtcaccagtcccaatgctcgggctagggtgattcagtgggttagagaatggtatgaaacgcacattgtctaccgctactcaggagaagtaattcccgaagaaatgccgcaatacgaaatttcaaatttgcccgagggttatcaggaaattgatcgttttaccttttccagctatgtaagcgtaatttatcaaaacgaggagggacttccgctatatctggattataacttcatccagcaagggggtgcccatgattttgtaacgactaacatggatgtatccgatattatagtaaatggacatgcaggacagctatttatagcacaggattctaaccaaggaagcgcaattacttgggttgatgagaaccagaaccttcaatttacgattgacggtttcgcagaccgagaatcgttgctaaatatggccgaaagtgttaggcaattgcttaaataataatttcatattttcaaaaatttttgtgaggaaatcacctcctgctgcatttacttgataggaatccccaaaagcgttcttgtcaaaaatgttgagggaggtgatttttatgaagaaacatatggtttctgcggtgctattgctcattatgatgctctctttgtcagcacaagcagccgagatgcgagtcatcacagccagtccatatctaacgtttaacgaaaacactgccacctgcatggcggactgcaaaagcacgaatcccagtgataaagtctcagccacattgacactctatcaaggaagtacctgtgtaacctcttggagtggttcgggaaatggccgagtcattatttctaaaagttgtactgtaaagagtggcatggagtacaagctggtcttatcctattctgtaaatggaaaagctcaagaatcagtttcggttactgcaattagtcccaagtaaattgcggtcgattggaggtgagtccgatgggttagcgattcggcggtccccaacttttctatttacttgcaggtaggaaccaccagcaaatccatagcaacgcaaccgccgaaatagcaaacattcctgtacctttcgtccaaggggaatcattccctacaaaaacaaaggagatatcaacatgaaaaaagttaagaagttcctgagtgtcctctgcgcagcctgtatggcaataaccttgctccccagcgcaatggctgccgatcttccatcggaacccaatgtgtaccggttaatttcagcacaagaatttaactccatagctcctcgttctacagcaacaggaagggtgatgctcccgcggtcgaactcgagcgggactaatggtgtcgcctgctccgaattcgttgccgatgagagtaatgtatcctttaccattgacagcgctcccggttgcacaaattataatgttcaactttatcttgggacaatcaaagatggcggctcccaagtttatttgtttgaatcggttaatataggagcaggggcttcattctcggggctagagatcggtaagacttatttctttaaagttagctcatcgactgcaccctcttccggctcaaatgcctcgtggacacgcaaaacatatccctaatttgagattacccctgtataactttcatgttatgctcaggaattactaaaatatcttgtagtgtatcaaatctacctttcacaaccgaagtgcgcggttgtgaaaggtagactatttctaacgtaattgaataaactcctttacaaattgaacggagggatgctttttgaaaaatataaaacaattatttgtttgcttgcttgctattagtatgactatatcagtctcagcccatgcaattgctaccgatgctatggagagtgctatatctccaattgtcattactgcaactgagtttgatgcaatttccgctcaaactgaacatgtaggaagaattatgcttccgcacacgaatcctgaaggctctaacggaaacagttgcggagaattcgtagcaaacgaagccaacgtagcattctctattctctctgcccccgccactgaaagctacaatgtgcagctctatcacggaacagctagtagtggtggtatccctgtgtatctctatgcgaaggatgttcccataggttcaggggtatggttctccaacttgatagttggggacacttatttttttaaagttagttcttccaccgctccagtacccggatcaaatgcccgctactcgtacaaaacattttcttttccaacaattacggtatctaccgatgttgcggttgatattaaaaactagtgttagacttccaacttttcacttccatataacgtaagcgtcaaataaaaaacacaggaacgggaaaaacctccgttcctgtgttttttatttgacgcttacgaatattgtgtaccattctttatgcgaacacctcattataaatccatgtggcgggcgttttgtgtccgcaatatggatttgtacgaaaaagcggccggaggccgtaatgattatgaaattaggagttgagtgactatggcagtttttcgtgtggagcgcacccagaactataccgtgatgagcaactaccacctacgggatcggaggctctccctcaaggcaaagggccttctctctctcatgctctcactgccggaggattgggactacaccctctccggcctggcccgcatcagcctggaggggaaggatgccattcgggccgccgtggtggagctggagcaggccggatatgtccagcgccgccagaccacggacaaagcgggcaagttcagcagcaacgagtatatcatccgggagtggcccaacccagagaagctgccgccgaaggggccgtctgcggctgatccgtcgtcggaaaacccgacggcgagaaaaccgtccgcggccttcacgtcgccggagaagccaacgcaaataaagaaagactcagaaaagacgaatatagaaaatactaacttaccaagtatagaatcctttcctttctgttccgcgcctcccgcgctggaagcgaaaggaagggatgcgagacccaggagagggtggagtatggatgagcatgagatggccgcctaccgaagcatgatccaggaaaacgtccgctatgatgactttgttcaggagcacccctgggatgtgggccgtctggatgaaatggtggagctgatggtggagacggtctgttccaccaggagaagcattcggattgcagggaacgacatcccccaggcggtagtcaaatccaggctgctgaagctggacggtgagcatatccgctttgtgtttgactgcctccagaggaaccccacggagatccgaaacatgaagcaatacctcctggcggtgctatacaatgcccctgtcaccatggagaaccactatgcctcccaggtcaaccacgacctttatgggaaagcagcgtaatccaatataaatttctcattcatttccatgcagggtaggcttccgtaccagaacatggctgctgcacaatttttgtgcgtgtttatacatctgcatcagattcttttggggaaacagcatttgaaatctttcttttccgtccagaacgactctttttagaggccaaaacgattttgaaatacaccattttgctctctacaaactatatcttaaacccacacactaaatattagcgattctgtatcactgaatcgtttcaccctatactaatcatgaacaatgtaggaaatggtataggagagtgaggcaagcaggatgattgataagcgtgttggaaagcggatcaaacagcgcagagaacaactcggtttgacacaggaacagtttgcggaaaaacttggtgtggcgactaactatatctcgacgattgagcgcggagcctcgtttccacgctatgaaaagctggtggctatcatcaatgcgcttgaaacctccgctgacgcaattttctgcgatgtggtcacgcactctctagagtacaaaagctatatgctgttggataaaatgagagatttgccaccagaagagcaaaaccggattttggaaacacttgattttctggttcagcagtccataaaaatgagaaagactgtgccttaaaccgcacagtctttcttttttcgacaaatttctccacattccgcctttctctcatgatactatgtattagcgatatatactaattcaaaaacacataggaggagatatcggtggaatcgaaagaccggataccccagaacttcgatgttttggacctatccagggccatgaacagcttcaaacgggagcagattcgcaaaatattagaactacccgatcatcagtctttctccatcgtccggtggtattccccggcggaagtaaagccgatagaagcgacatatgtcatggcgaaactttatgagccggggatcggctttatctgtatcggcgcggcctatgaacacgggcgattttgggagctcgatccattgaaggacaagccgctggaaatcgttcgtgtgttggcctggtcttatcctcccctggatgaccgtgttgatgagcttggacagctgcaatatttgagcagctagtctgccagcggtaaaataatgatgtagtaatacaccgtattctgtgatacaatgcagaaaaagaagacaggcacttgaaactgctgtacctgtcttcaatcgtccaagatatcctcaaaagaaaaatcgttcaaatccttaaagttcaaaaactcacttacggtcatgccaaatgcaagagcgattcgatggagggtacatattctggggttgaatgtcttgccatttaccaaattgtcaagagtggattggctaactccgctcatttctgataacttattgacagagatgcctctgcttttgcatagcgccaaaatcctattaacaagaatctgtgcatactgctctctcgctgctatctgaagacccccccatcgcagtttagtgtcttcatgatagcaataatcatacctcagattacccgtatacgggtaatccagcaaaattctctgtcgtatacagccactgctggatgaaagtaaaatatgaccacgggcgacacctgaatgcggtctgtggcagatttcaagatataaggaggagctgcaatggaacactcggtcccaatttccgatctcccatttaatgtccacgcttttgagagtagatatgggaaaatccgctcggcggaaaagctctgtccaggcgttttcagaatcctgacagttcccattcctctcgatcaatttatatgctccgacttatttgtggtaatggcagattctcccgccatcccactcactgcaaaatcctatgggataccgctggaatcatccccagaagtccttgtggtgtactgcaatgcagattattttgacaagtcccggtgggttatgacctatgaaattgataagtatcttgtagatcataatttccctctgcccgacggagaatcattactagaagttcgggtacgggggatggaggtctgcccggagtattttggagagttcccgatcccgaccgaaactccgtggggcgctccactccagcatgaccgtctggcaaatggggttttctggctgagaacagagaaagctgggtgggtcctggcgcttgcataccctatttgtgacagccttcttccggaaactgtaaagatagctgtgctcaatccatatgaccgggagaacgggattgacaagacatgcggattccgctttttcaagtatgagcagagctgcctcccgctttttcagcttttgaattgtgcccagcagccctggagcgaccggatcaatacggctgccctacaaaatgcggttctgtatgctcgggagtacaacaaaaactgtatagaggcggatcagatagcggagcttcggcacaccccgagcgacggaacctgctattatctgttcccggcggaggatgcatgatggccgtatgttcatttctgggacaccgccatatctacggccatgatgtacagcttaggctgcaggccgcagtcaaccatttggttgaagaaaatgattctgtagagtttctgctctatttatggaaatccacagagccattttatgctttgtgtctgctggccgctctgagggccaaacagtgtgcgcctcaaaaagtgaccctgaccttggttgcggaccgtttagagctggaacagcgtttggcagacaaatggacccacccgctctttttcatcgcggacaggctgcttccgctttccgtatccaaagacagaaatccactcaaagtcctaaaaagaactgtccaatggatggtcaagcagtctactcacgtcatcaatggcttttatgaagacctttttgatcgggatgatttcgtccttaatttcgcaaggaatgctggagttcagatcatcaatgtcacagcaccagagctggagcaggttatccttgccagttctgagcaattacccgagcggcaacgtcttgtttttcaaatgcgaaagtcaggatacacacagaaagagattgcaatgcacctcaatttgactgtgtcccgtgtgcaacagattgaagctgctgttaccaaaaatcttcagaagcaactggattccataagctcctgtattcccaaaatccctcaaaagttatcggtatgtagtatttttgcgttgggcgatgccaactataaaaacctatgtgttttttcaaactgtatccgctttttaatgacgcggtatcaaattgaccaattttgtctggaggccgagaccgtccactccggatttatgttcgcactgcagcaatccataccactctatcataaaattccaacaagagctgtggcctgggatgctggttctagtgaactatatgacttgaaggccgaattctgtccgccatgtgatgccgccgaaagcattgggggtatccctgctgtcgattgccgcatcagcacgattctggagctgatggaccgctctatgttctgcatctgcgacctgtctgcctcggcctacgcccagcagatcctggcccatattccgcagacaaggcaggctgttttgctggatatcggtaaaaatacggctctccccaagtctgaggtactgggcgagtggtctaattctttacaattatcatctatattccctgaaggatatatactaaaataatagcaaagaaaaatcgggggctttctgaacggctccagtcatggagagaaattcaatgaaaagtatctatcagctcacggcattgatcggcaataaatcggacgggatcaatgacgaaaaatttatgaccgcagcgtggattctctatgcctggatgcgccgggaggtcatcgactgcattccgctcccggagcttccggcgaccgtaagtaaatcagcaaaaacagggcggtctgttgcatccatctaccagccggaagagcatttctttaccctccgctcctctgtgtttgagaacggcatccgggacaccgtcgaggccgagatcatgccataccgccaaagtctgcttcttgcagtccgggagaccgcttttctccgggagcccggcgccaaagcgaagcccgcgtccggaccgctggcatttgtgcgccaactgatagatgaggtgggcctgaatgatggccgccagctttcgacaggccttcagcgtattaccacacaacaggttggcgagctggccgactttttgtgtgccccagaccgatggctgccagttgttgtggtctcccaggccaaaaatcccgcgctttggcaaaatggatatttggttgacgttcgcgagctggcctcagatctggctggcagcgcccatgtaatggtcatcgactgggacgtgacctatgagttcagccggatcgttggggatgaatggtcctgcttcggcggcgctgtccgtatttactggcccgagctgtttgactttgaaacggatgacccctatgtccatccactttacacagcacagaccatccggcgcaatttttaccccagcgagtttgagaaagaactgaaaaagataattcgggcccgaaatgccgggcaagtcattgcctggaatcggtttggcatccggttttatgtggaagcagagcagatgcgtatgctctccgtcagtggagaagagagcacagaggaactgttgaaacagtgccgggagcaactatgccgggtgcacgagtcccaagaggaatataaggcgctggctgagacgtactatgccgatatggtggcctgccaggaggacagccaggcactgcaaaaacagatgacagccatgacggagatgttgaaccgccaaaggcgggagatcgcacgattgaatgggagagcggaacagcctccggtcgatttgggctatgagcagatggcaaaatgggtggaacaatattacccggaccggctctacctgcatccgcgggcagtccgtgccctgaaatctgccgtctatcaaaacccatctatggtctaccgctgtctgatccttctggcggaggactactacgattaccggatggggcggatcaatcgagacacctttttacagtgctacgctaaggtcgatcccggcctgagcgaatgtggatttggaggagccagtgatattctggaacagggagacgaatattacatcacctatggagggaagcgacgtctactggagcggcacttgaaaaaaggtgtcaatcacaatgccctctactgcctgcggatctatttcttttgggacgaaaaaagctctcatgtggtgattgggagtctgcctgggcatctgcgttcttctctgacataaggaaatgtgaggggcgtggctcatgctcgcctttctggtcacactataagtgatatggcgatatagataaaacatatccgggatgcgaagggggaaatctgacttactgagtaggcggggcttatctgaaagtgccggagatgaagcctctctactcctaatttagtatttcatcaagtaatgaggaatatatccatagctcaggatatgtgtttagaaccgggtgactaaagcaatccaggaccttctttaaatcatcccagggtttcattgggaattgcagggaatctcacctggatataccaatgtaagcgaggggcggcccactttgttgggccgcccctgcttcctaaagaggttccttgatatccagcggaagatctccaccgtacaacgaagtgtcccatgtccccattttccgcctccttcggtaaaccttatccggcccccagaacaatgcttgagggccagacgggtatgcttagtcgctatttacaaaatgtactactctattcattcaaacgtaattgtagtttcgtcctccaaagatggagtatgaggattttcccaaacgaatattaaactgtagagttccaattatgtatgccatttggcccatcgcattctggaacctcctgactgaattttacctcagcatgtccaatcacgtacactggacatccttcgcaccatacatccctgcaataataaagcttctggtaaaccaatacagcgcttcctttaagtccagcatgggcgcggccccaaacgcttccatatcgggcatggcatctcccttccaatccagtacaacaaggtccccgcactgctcaaacgttggatagcggccacaactggtgggattatttgtatatccgatggcctgcaccatgaaatacttattacaatatatttcgatctctggctttcccttcaccagttctggaacaagctggactgaaataacatctcctatcttgtacttaaacttcttgggtttgggacgcttcactgttttgagcggcccctggggggattccagcttcttgcgcagccggtccagcacacgttgccgactgcggcggtccgactcgctgactccttcccattccgccatcgccgccccgttgtccaatacctccagcgcattgcgcagggtatcctccgtcatctggcccagcttccactggatgtccgccaagaccagccggaatacagagagatcctcctcgctcagctgcagctccttccagaccagggccgccgcctcttccggcgtgtgaccatcataaagctgttcatagtattcgtccttgatatccagcggaagatcgccgccatacaacgaggtgtcccatgtaccaattttccgcctccttcagtaaacctatccggcccccggaacaatgcctgagggccggatagctttaggtattattttgtggatgttgcttttggtacgcccttactatatccaaaaccacatatttccaagtacgtgcttcattcagcattgtaacacgttcaggaacatcttgctcaaactttatttcagtattcccaatcacggtacactgaacggcattcgcgccaaacattgttgtaacagcaaaacttctgataggccaccaaagtaccgtcaagtccagcattggtgcttttgcaaattcctccatatcaggtatagtatctcccatccaatcaagtgccaccacaccgccgcactgttcaatcagaggatggcggctgagactggtgggatagtctgtgtatcctaccacctgtaccatgaaatatttattgcaatatgactcaatatccggattttgctcggcgagttctggcacaaaccgaactgcgataacgtctcctatcttgtacttaaactttttgggcttgggacgcttcacggtcttgagcggcccctggggagattccagcttcttacgcagacgatccagcacacgttgccggctgcggcggtccgactcgtcggccccttcccattccgccatcgccgccccgctgtccaatacctccagcgcattgcgcagggtatcctccgtcatctggccaagcttccactggatgtccgccaagatcagccggaacacggggaggtcttcctcgctcagctgcagctccttccagactagggctaccgcctcttccggcgtgtgtccctcgtacagctgctcataatattcggccttgatgtccagtggaagatctccgccgtacaatgaagtgtcccatgtgcccattttccgcctccttcggtaaaccttatccggcccccagtccagaacaatgcctgagggccggataggggggcttagatgctatccgtagaatgttgctgcttataggccctggctatagctaaaactgtagagttccaattatgtatgccatttggcccatcgcattctggaacctcctgactgaattttacctcagcatgtccaatcacagtacactggacatccttcgcaccatacatccctgcaataataaagcttctggtaaaccaatacagcgcttcctttaagtccagcatgggcgcggccccaaacgcttccatatcgggcatggcatctcccttccaatccagtacaacaaggtccccgcactgctcaaacgttggatagcggccacaactggtgggattatttgtatatccgacgacctgcaccatgaaatacttattgcaatatatttcgatctctggctttcccttcaccagttctggaacaagctggactgaaataacatctcctatcttgaacttaaacttcttgggttggggacgcttcactgttttgagcggcccctggggggattccagcttcttgcgcagccggtccagcacacgctctcggctgcggcggtccgactcgtcggccccttcccattccgccatcgccgccccgctgtccaatacctccagcgcattgcgcagggtatcctccgtcatctggccaagcttccactggatgtccgccaagatcagccggaacacggggaggtcttcctcgctcagctgcagctctttccagaccagggccgccgcctcttccggcgtgtgtccctcgcacagctgctcataatattcggccttgatgtccagtggaagatctccgccgtacaatgaagtgtcccatgtgcccattttccgcctccttcggtaaaccattctggcccccagcccagaacaatgcctgagggccggataggtgtgtttagtcgttgtccgcagaatgttgtgtcatataggccatggctatagccagaagagtagtacgccaattatctatatcatttagccaagcacattctggaacaacttgactgaattttacctgagcatgtccaatcacggtacactgaacatccttcacaccgtacatccctgcaataataaagcttctggtaaaccaatacagcgcttcctttaagtccagcataggcgcgtcctcaaacgcttccatatcggggatggcatctcccatccaatccagtactacaaggtcgccgcactgctcgattgacggatggcggttgcaactggttgggtgatctgtatacccaaccacctgtaccataaaatatttgttacggtacatctcaaactctggatttcggtcggcaaagcaaggcataaagcaaattgaaatgacgtctcctatcctgaacttaaacttttttggtttgggacgctttactgttttgggcggcccctggggggattccagcttcttgcgcagccgatccagcacacgttgccgactgcggcggtccgactcgctggctccttcccattccgccatcgccgccccgttgtccaatacttccagagcgttgcgcagcgtatcctccgtcatctggcccagcttccactggacgtccgccaggatcagccggaatacagggagatcttcctcgcccagccgcagctccttccagaccagggccgccgcctcttccggcgtgtgaccctcataaagctgttcatagtattcatccttgatatccagcggaagatcgccgccatacaacgaggtgtcccatgtacccatctatcctattttcctcctttttcattcagtgtccgaagccaggcggcacggtctcttccagcatacacagcagctcgttctctgtgatgtcaccgaccatctccgcaagaacttttactgtattgctgtatttgtcagatcccatcttctccgggctaatgcttctaatccggttgtatgctgctgcatacagttcatcaaagtagatggtcatatagaacatctctttggctcgggcatcatttttatctgtcgcttttgcaacaacagttaaatctactcttttatccccaaatttaccactagcattatgtgaggcaagtcttctttccggctcaacagtcataccgacataaactacatcattcttgggcggtatatttagtacatagacacaatagccgcgttccagtttctgattcgccctcgcctctaccttggcctttacttcacatctaatttttgtaaaatattctttgtaatcttctgttcctgcatacgttacgatggcagacccatctacaaccgtgactaagtagtcgtaagcggagtttttgatagactgaatatagcttttcagttcatttctttcgagggtgtttgcgccaacaccaagtgcatccagtagttctccttctaattcagaagtagaggggacataggcccctatggtcgcttgatcaaactttccgatgtcctggatatttgtcagcgtctttgtatactcctcatactcctggatagactcaaaatacgtctcaaatgtacgaaccccacgattgatatcatttataacgcgattgtagccatcaaccaaattgggataaaccatgtctgcgaccgtgcgacacagctcctggaggcctttgaacaatataacactgcctgctgctattagagtaaatgctccagcagaaaggactaccgttaacgccatgcggccatcaggatcaatttttgttatgggagcattttcaacatacaaatactgaatatattgagttggattatctggtgttcccttcaatgggtccattgcggtaaaccgtttattgggggcatcgtacatccgcgccttggcgtagaactggtccagcacatcgtcatactcatgggtagcataggtcagttccgggagcaggatacggaacccctggtctacggtgatgtctgtataagcgcgcacctcaccccagtcggtgtagtccgcccgggccgtgacacggccatactggtcggagagattcaccacgctgcccagccggtcggtgtgaacataggccatgttcacgcatttctgaatgttctgcccccaccaatcgctgccctcgccagtgacctttacctgaaccttatccaggccgtagacatagcggaagtcatagccatcttcctcggatttcatcaaaacccgctgatcgacatccagccgggtgtagtcgatcacatagtctgccttcacgacctcggggccatgggggcctcccaccgtggtctcgatgctgggactctggcagtggaagtctgtgtagccgtgggtgttgtcctccaagatcagctccgacccgacgcgcacacccaggccattgaaagtgtagagacttgcctcaccagccttgttagtgccctggaccatacggttggtctcatcatacttgtaggtagcgatggtgatggtctctggcccggtggtagtgggggagcagatttcctcttccttcaccaaattaccgcgcttgtcgtaggtatagccgtaattatggatacgggtgatcgtctgctcatagccgcatactctcttggccgtcatttgattcaggtcgttatactggtaggtgtccagatcctttgttgttggaccggcctcctgcaataggttgcccagggtgtcataggtgtaagtataggagagagtgttgtaaggatagatctccagcttgcgggtgctgccggtcaaacggttcaaagcgtcataggtatagtctgtatggcttttcttgttttccaccgcatcgctgtcccgctggaactcatgggtcacgttaccctcagcatcgtaggtatactcaaacttgatagatggcgtcttgttgtagagttggaaggggtcgatatctaccgtcttaatcagattcccctcggcatcgtaggtgtactcctccacccagccattggggtagtgcagcttcaccggccggttggcatcgtcataggtataggcataagtgcccttgtccgggtcgatcacactggtcagattgttgaccgcatcgtagaaatttgaaacgatgcctccgtccggatactttaccgtaacctgattgcccacctcgtcgtaggtgtattcggtcacatttcccttgtggtcagtggcctttttgagttgtctcagcaggtccaattcaaaggtgttggtgccggtccagtcatccatttggatcagttcgcctaccttgttgtactggtaggagaccgctttacccccattgtaattgatgctctgcaccaaatcaagggctgtgtaggaatattctgtgacatagccgtcggcatcagtcttagacaccaagtttccattgccgtcgtagacgtacagggtgctgtcgcccaaggcgttgatctccttggtcaccaggtttctgccgtcatactcgtacagggtgatctcatggctgtccacgttattgactgtatccatacgatggagatccatggagataagctggtcattcttgttataggtaaagaccgcttcagttccaagagcgtctatggtcttcacaatattgccgttgccgtcgtagatgtactcggtcaggttgccgttcttgtcccgcactgcagtgatccggccaatggcgtcgtagcggaaccactgtgtattgccccggcggtctgtctggcccaccacccggtccattgcatcatacaggtaggtggaagttcctgccgcgtcagtcaaggaggtcaggttgtaattggcgtcatagacatagctggtggtcacgcccttggcgttggtctctgtactcacgttacccaccgcatcgtaggtataggtggtggcattcccctttgcatcggtgaccttgaccacccggtccatcgcgtcgtactcaaaggaagtagagaagcccagggcattggtcatctgggtaaggcggccattttcatcataggtgtatgctgtcactgcaccctcttcgtcaattgccttgatcatccggccgtctgcatcgtactcgtttgtggagggattgccctcagcattaatttgctctaccacccggttcagtccatcgtagacatatcgggtagtattgccgttgccatcggtctccgagacgacatttccatttccgtcataagtgtagaagaaggtatacccctcggcatcggtatagcttgtaagttgatttctggcgtcataggtgtagctggtcacattgccttctgggtcagtggtcttcacgatattcccattggcatcatactgggcataggtgacaccgccattggcatcggtaatggagagtgcccggcccagtttatcgtaggtgtaggaggtggtattgcccacagcatcggtggtggaggtcagatttccgttgacatcgtagacgttgctggtaacgcctcccatggtgtcggtcgtagagagcaggttgcccgccgcatcgtaggtaaagctggtaaccccacccatggcgttagtgatagagctcatgcggccatcggcatcataggcgtaggagaccacgttgcccaacgcatcggttgtggagagcaaatttccattggcgtcatagacgttgctggtttcagtgccatccttattggtggtacccactactcgtcctaatctgtcatagaggaatgtcgtggtgtgtcctagagcgtcggtctgagaggtcttccggtcacgttcatcataggtatagcgggtggtgtgtcccatggcgctggtaatcttcagcagattgccgaccgcatcatactcgtaggttgttgtattgcccagtgggtcagtctgagaagtccgtcgtccatctttatcataagtgtaatgccaggtgttaccgttcttatcagcttcctgaataagctggccaatggcgtcataagtcttactggcactgtagttgagggcgtcggtctcattggtctggcggccttcattgtcataggcataagtagtccgtgctcctctggcatcggtaatcgctgtaatacgtccaagcaggtcatactcataacgggtcacgcctccttccgaatcggtgaccgtactttgattgccgacggcatcataggtatagctggtagtaccgcccaacgcatcggtgaccgtgcttacccggtccgcagcatcataggtataagtagtcgtagccccgttagcatcggtgacggaggcgatattgttatccccatcgtaggtatatgtggtcgtgaaccccatgggggttgtcttgctgagcacgttacctactgcatcataggtggaacgtgttacgccgcccataggatcagtcatagtgagcatatggccatcggcatcataggtataggatatcacaccgcccatctcgttcgtggtggtaagcacctgcccgttggcatcgtaggtgtaagaaacgctggagccatcagcataagtagtctttgttacacggcccagagtatcgtattcctgcgcagtgatgcggcccaatgcgtcagtgaaggaactggcctggttcagggtatcatactccgtagaggtctggtttccctccggggtggtggtggagatcaggtttccaacttcatcatagctgtaatgtgtggtctggccaagcgcgtccacgctgcttaccatgcggttgttggcatcataggtataggtcgttttggcgccggtgcggtctgtttgggagagcaggttgccgttagcatcatattccatcacagtgctgttgccaagcgcgtctttggttcgggtattatttcccacaccgtcataggcataagaggtttcagcgccgcgggcatcggtggtagaactggtacgccccgtactgtcatagaccgtggtagaagtcccgccagcaggatcggtggaggagacctgccggccatccttgtcatacttgtagctccaggtgccgccattggcagttgtcatagagatcatctgcccggctgcatcgtaggtgtaggtagtagagtgaccgttggcatccgtggtcacagtcatgttgccgcgctcatcatatccataggtcgtggagttccccatcggatcggtcatcttgaggacttgattctggatatttcgttcgtaagtggtatggttacccatccagtcgctctcgctggaattgaagccgttgccgtccactacataagtttggatattgccctgggcatcggtagtcttgaccagcttgccagcttcggtatattcgtaggttacggtatttccctgggtgtcggtctgggatatcaggcggccctgcccatcatattccatagaactcttgttgcccttggcatcagtgacggatgtgcagttacccgtgttgtcataggtataagtggtagtgttgccctcagcatccgtttgagaaagcagattgcccatagcatcatactcataggcggtcgtattaccccttccatctgtagaggtcaggacctgtccattcccattataggtatagctggaggtattgccgtttcggtctatgaagctggtgacatttcggtcttcatcgtaggaatagctttcgctggtcccatcgggataggtgatagcggagatgttgccattattatcgtgttcataataggtggtattgccttcacggtctgtctcggaaaccctttgattcaactcgtcgtagctgaatttttgcgtaccattctcattggtggattcaatgatgcggccaagctcgtcatacacgatggataaataatagccatcgctcccggtactggtgttgcggcggttttcaggatcataggtaaaatcaaaggtgccgatgtcggcggcgtactgatggatgacacggccttcggagtcataggtattctctacatacacctcgcccttgaagttctgaactgtggcgaggaggccgttttcgtaggtgtaccggaggctgtcaccgtccggattctctgcggagatcagagaatcaccgtcatagctgagaagaatggaacggcctgtgctgtcggttacggtttccagattgccttcgctattgtaggagagcgcaaaggaaccagtatcgttggagatccgagtgagctggtctccattgtatgagagagaaatagtattcccatctaaataggaaatgcgctctaacaggccgttatcgctgaaatcgtagacagtcccattccggtcagacagatggaagccggtggaatcccgatccaaagtgtaggcagagccagccttggcttgataagagccatcgtagatgaggtcaaaataaacgtcatgaccaccaggtagcgttactttggcatagagcaggccggtttccagggaataactgtaattgtgagaccagccgtttcccagagcatgattatgctccccatcggaggactcataataacgtatgaaggatagatcattcctgccgtagagagcaaaatcctgatattcccagctaaaactgccggtgagtaggtcaacaggatcttctgtaagttctcgataaagttcccaaaattgagcccaatccgcaagattatcctcagaatggtcgatttcaaaggccaggaagctattatagaccgctgcaatatcggtggtgggctccagaacgattacatagcgggcaccgtcttcgtattcgggcaggaagggctcggcaccttcactttcgaccacgcgaccgtcccagaggatgtagttgatgatggacttggctgcgtcttccagatctccattggaagcaaatatcgaaccgcgattgaagataacgtcatcatatgtcagttccggacgggggtcatccgccaactctgaggagggggatgactccgggagagggaccgactcagatggagcgggttcgattgagggtgcactttcttcgggcagaggcacaacactttcttctggagcagggctaacactttcttctggagtgggtactgcgctttcattcggcaacggctcagtggtttcaggcagagtgggagcctccgtttcgacaggaggtgtagattctttcatggcaccctcttgttcaggcatcatgggctcctgtgtggctacacttccctggagctcaggtaggtcaccagccattccgaccggaacatgagaagagagtgcgttggagagttgctctggcgttcctgtagactcagaagttggttcattttcactgggaatgggattttccgactcgaaaggcaggagttcttctggcccccctgggaccggcgttgcagattcgtctggggcgggaagctcactttcttcgggaacaggagactctgtttctgttgggggcagatttccactttcctccggtagaggtgtctccgtctcaacaggagtcggagtatcggtcacttcgggacttgcgaccggtgtttcggtcggtagtggagagatgttttccggagtaggaccgcccttatacttttccaatgggagcttctttccggcgaagccatatgcgtagtcaccaataatcgccttctgaggtcgcataccagtagcagtctcagagataatatacatccaatcttccctggagagttggtggccggtaacttcctcggcctcctcatccggattatcaatattatctaggacccgggttccatagagataaccgacaaagtccgccaggaagggctcaggatcggtggtatcccccggcaccagctcgacctcatcaccagtccattcatccccttccgccatcttgtagagcgccagactggcaggttgggattgttccagggtataaccaaccttaaccagagcgttgttactcaggtttatgccgcgatagaaatagttggtcatttccccgttgctgtaaagagatatttcctcagcattgaggacattttccatggtcatgttcttgagctctgcaactgtgggagcatagtcggggtctgccgcaaaagcagccatcggcaacatccccagaaggagcgccagggtcagggttgaagcaacaacgcgtgagaaccgttttcgtgccttcatatgtatactcctctcatatcgttctgatagcccgacttccttgggacaccagaaactagccccctttccttttctgaatattgaaaataagttttccaaagaagtccttctatatattgtagtgggcaaaaacgcagaaatcgtgacatataatattaagaaatttgtcaaatttaatattgtaaaataagagaaagaagcaaatatgatagctcaaaatattcttttaatagtatcatttcaaaaaaatattatttaaaaaagtatatatttaaaattatgataaaaattattattttaatcatcctaccgatagatagaaattggctatcatattatggtaggtggtgatatgatggcagactatcccaaacaattaagggagcggataaccaagtttcgggaacaaaaaggggtatcggaaagcaggatgtccagagagctgggacaaagcaaatgttatctgcagcagatatcttctggaaaaacgctgccttccatgggagcatttttcaggatatatgaatatcttgagacgctaccgatagaattcttttgggatgacggaattgattcgatatatatgcatgagcttctggggcgtgtaaaaagtatgacaaaggaagatgccgactacttgctcatgtcggcaaaatatttgagcggccggggatatacttcaaaaaatcaaatctgatttttcaaaagcgacctggaaaggcgcaaagtgcaagcccttggaggaacattcttccggggcttgtctttctgtgtgtgtttataaaagggtgaggcttaaatgaaaaagaaaccatggaagaggttaagtcagtcagattctgaagctgtgatgcggttggtggatgaatatcagtcgagcataaaacggatcattgtatccgtcttaaaaggacaatggccagatgcagtggatgatatacttcaagatacatatgaggagatatgcagacagctcaatttgattgaggaggcagagaatcggcgcgcatatgtgtgtaagattgcagccagactggcgattcaagcgcacagaaaattagggcgggatcttccgttggacgaagacgtccctgcaccggaggatttatccttcaacctggatacgattctaccctgcagcctatctccatccgataagagattgttgaaaagagtctatgaggagcaggacaatatcgtagacattgcgaaagaattcggaaagaaggataccgcgcttcgacagcagttaaaacgggcccgcgaccgagtcaaaaagattattatgaaggaataaatttaaatagtatgtcacgttttagaaaataggacccactaataatagtgaggaggtagataagatgttgcagcggaacggtgaggacattgcttctaaaagcgtcttcaacgaagctaatttgaaagaacatcttaggggaaagaccgcagatgaactgattgaggagttggaaaaactttatgatgaggaggaactgactggggaagaatttgatccgcggattgtagagatctatattgaagccatggagaaggtaagccccccagatcctgccgctgaacgtgcgtttgatcgatcttgggcgctgttccacacgaagcatcgtgtcgaaaaagaaccttccagttctcatagagctgtaaaaattcgatggcgtatcgaagctgccgtgcttatagttattttcttatgcgtatccgctgcagcatttggttggaaggattatattattacatggaaagatgaactgtttggaacagtgccgcacataccagggactatggaacttaaggaaccgaatgtgtctggctatcgttcattgaaggaagccgttcaaaagtatactgacatttcggtcgtgcctggatggattcctcctgggtatacgattgacgagatctatgagatggaagtcgagtcagctgacgttatatcggcaacatatagagacggacagaaaagtattgttatcagagtattttgctaccgaaatacggaagatatttcggatttgtgggtagaaaaggattctggtctgtataaagacacttaccagacgcacggaattgaacatgccatctcagaaaattatggacacacgcagataatgtggagaaatggtcaatgcacatgtagtattacaggggatatttcccgagcagacgctgaaagaatgatcaattctatctatgaaaacgggggataacaatgaaaaaaagacttggaactgtacttttattagcactctttgtcatttccagtatgatgcctacctctgcagccacagcagagatctggaatgaagcaagagccagccactactttgatgcatatatgctgggcatatccgcgaagggagggggcgaaatggcggtttcgttcggtgtattcgggacagatactatggataaaattggagtatatagtctgcggattgaaagcgaaatcgcccccaacaaatggatagaagaattcactgtatacggaagcagtgatccggacactttctatgctatggatacaatacagcacggcggcgatttctattttgacggaatgccgggtgtaaaatatcgtgctgtaatggtggcatatgctaaaaatgcttccggctatgaatatagcaaggagatggcatgcacaggacggtactgtgaataaaaatatttacatttctgcaggtaaagttatatatctcgaacctttatctaatatctaagctggtcagtgcgcaaaaaacagagagtaggagtatacccctactctctgttttaatttttatatgggaaaataaagtacattaaagcaagggacaaaatatggtggggacgctcaacggcgtatgccaacgagatcaagcggctctttttgcgtccatccagctctttggtcgagttggatggacgctttttgtttgctgacataaaaaatctcgaaaaaagtttttaatccggacatgagctgtccgctttaacctgtatgattcggccatgtaggtaaaagggggggagtgtgtgaggatgaacgatcggcaacagcagcttatcagcctgctgtgtcagcgtcggagtgatagcattcaaaatctggcgatggaacttggtgtctgtgagcgaacgattcgccgggatattgaagaactcacacttacttacccaatcgagactgtccgtggccgatatggcggtggggtcaggatggcagactggtactttcaggaccggccaaaactgactcccaaacaaacagcgctgctcaaacgcctagctattgggctgcatggtgaagatttagatgagatgaatcgaattctcacccactttgcttcctgaaggagcctgactacaggcctcattgttctttgacaagttcataccagcagcgcggaacaccacacagacaccagatccaatgtgcgccaagacccggaggcccctggggggcctcggcgagcgataccacagcggatcggacggccccggcaaggtcgttttctcattccctggactgaaagcagtagaggtccccggaatgtgtttgtgaaggtctgccacaccttttccgtgctgttcctaactcaccgggggagcgagctgcaaatgcggtgagatgatcagtaaccaaacaaatgatatgaggatttgaatgatggaaaaatgtaactacaggaaagaccctcaccaagatattgaccatgtcttccgggacttgctcccggctcacgggatggtggagcgtccggcacaggtggaactgagccatcagatgctggacaccatgctgaatggtagcattgccctgtgcgatgccgggacaggcattggaaaaacatacgcctatctggtagcaggggtagtgtttcggcgataccggtcacgtgccggcctgccgaaccagcccctgctgatctccacctccagcatcgcactccagggtgcgatcatccacgattaccttccgttcctctccaaagtcatgatggctgatggtatgttggacagtccgctccgagcagtgctgcggaaaggaaaatcccactacgtctgcgatgcccgcctgatgaagcggctccagaccgcgaacctggatcggaagaacccgctggcaaaagcggcactcctctccatgagagaccatttggacctggacatggcccctcatctcagcggatatgaccgtgaacggatctgtgttcctccaacgtgtgactgcggcaagactgaatgccgctatctctgctatctggatgtgtgtgcctcagagagatatgccatccaggtttgtaatcacaacctccttctggccgacgccattcaccaagggagtgggaaacgccccattctgccggatagctgcgccatcgtaatggatgaggcccacaagttgccggagaccgctcggcagatgttcggtattacactggcagcaggagaactgcatactctatgtagaaaactgcggagggagcagttcctgctggcggcggagaccttggaggacacggcagggcttctgctgtctgagatagccaagccctggagcggagacagctccttttctcatttcagcatccccctggatggggtggaacgtaccttgtcggtgatccaccgacagatccggcggatgctgactgccggcaccaggatggaactggagcgagtgctggataaaacgaagctgttctgcctgcaccagccggacatggtgtattacaccgctgaggacgagactggcggttccatgctgtgtgcctctgctacggatcttacagcacagctccggcagacgctatggcagcaggaccggcccatgatactggcttccggcacgctggcagtgggcagcaacttccggcggttcaaagaggaaactggcctgctggccgaggggagagtgcgggagcatatcgcaccctctcccttcgactaccagcgaaactgtctgctgtacctgcccccaataacgcccagccaggccgacagcgattactatgacgaccttgcggaacagatcgtcaagctgttggacgcagctaacggccacgccctggggctatttacctcctacgcggccatatccgctgtgcgtgaacggctgaaacagcgggacttgccctatcccgtgttgactctgggccggaacggcggacacacgatgtcggagtttatggctcatccaggcagtgttctgctggctgctggagcggcgtgggaaggttttgattttcctggagactgcgtatctctgctcatcctccccaggctgccgttcccgatgccggacgcagtgaaggaacaggagcggatgaaacacgccacgcttcatgattttctccgggctgtggtggtgccggagatgcagatcaaactgcgtcagggattcgggcgggcgatccgcactgagacagatacctgtgtggtcgctatcctggatgaacgtgctgggaagaatcggcgctatttccgggacgtgctgactgctttgccggaagtgccggtcacccacagcctgaaggatgtggagcggttcatacgggctgtgaagccggaaggctacttcctggagggcgcggcatgagcaacatcaaaacagaactgcaataccggatcgccctgggtatcctgggacagatgtgttcagctggccttgtcaacgaccaggaggcagagaccatccggcggctggcagcagagaaataccgcccggaaactgttcggggattgtaatggatattccagcccaagtgtggtagtgttggcgttgaccaaactggcagaaaggagtcagcacgatggaatacgcattttacgccgagcaaatataccggctaaaagaagggattgtccaagccagagtgctgcctgcccaggaggcggaagcacttggctatgaggacggttatacagcctagaagccggagggcagactgtatgtagatggctttgacagcgagaccgcagccagataccatctggagggcctgacagactgtaggatcatgaattgagaggagttgagacgatggcagcaaatgtgacctacataccgcccaaggcggcaaaaccggaggccctgcgggttgcggcgtactgccgtgtcagctccgattccagcgaccagctccactcctacgccacccaaatcaaggcgtacacggagcagatcggcgcccatgcggattgggagctggtggacgtgtatgcggatgagggcctgaccgggacccggatggacaagcgggaggacttccagcgcctgctggccgactgccgcaagggaaaggtcgatcgtgtgctgtgcaaatccatctcccgcttcgctcggaacaccaaggactgtctcgcagccctgcgggaattatccgccctgggcgtgaccgtctactttgaaaaagagaatatcgacaccgggacgctcaccagtgaattgatggtgagcgtctccggcgctctggcccagcaggagtccatctccatctcccaaaaccagcgcatgagctacaagcggagaatggaacggggggagtttattacctgcaaagcccccttcggctaccgcttggtggaggggaaagaattggagatcatcccggaagaagccgagcgggtacgatggatattcgcatcctatctttcaggaaaaagtctggagtggattgcggaacagatggaaaaggctggaattccaactccggacaatgctccatactggcagaaaacatccattctctatatcctgaccaacgagaagtacatcggtgactccctgaaccagaaatacctctccggtggtttcccattcctcaaacggagaaaccacagcgaagccgaccagtattacattgaaaatacacatcccgctatcgtgtccagagagacatttgaaaaagtacagcaactgctccaacggaagggcgcacggcaacggatggaacacccccgttcctccctggtcaggaagatccggtgcggccaatgcgggactgtgttcagccgtagggcggggcgtagcggtctggtgacttggtcttgcagaaaacacgacagggatgcggcaagctgtccagtgggccggataccggaaacagagatctacgccgccttcgttcggatgtacaacaaactcagggccaacgcggacatcgtcctgaaaccggccctgacccaactggatgacctggagcgcgccctgcaacgggaaaaccccgccatgttggaggtcaaccgggccattgcccaggccgccgagcagagccataacatcagtaagctgcaagcagccgggctgctggacacggatgcctgcgccgccaagctgaatgccatcaacatccagctcacccagcttcggagagaacgccgccgcctgctggaacatgacgatatcgaggacaccatcggcaggctgcatcagacggcggacgccataaaggccgggccggaacggttggatacctttgacgaggatctgttcgaggaactggtggaggagatcgtggcagagagccagactcgcatccggttccggctccatggcggaattgagctggcagagaaagtcgggagggcaaaacggtgagctatcggaagatactgtatggctatcagatccaaaacggagaactgaccctagtgccggaggaggccgctgtggtcaatcgcatagcgggcctctacctggacggcctatcctatcagaagctggccgacctgctgaatcagaagaatatccccttcagccaggaagcgccggcatgggacaagcacaaggtcaaacgcctgctggagaacccccgttacaccggacagaagggctatccggccatcttagacggtgggacttttcactgcgtccagagccgcattcaggaaaaaacggcaaaacagacacccaaagcagagcggccagccctcaagttggtaagccgtctgcactgtgccgcctgcggcgcggccctccatcggatgggcggcaggaaccgccagagcgacaccctatacctgaaatgtgtccaatgcggcgctgtcatcaccatgcgggacgaagtcctgctggatgagatcgcccgccagacggcggaacaggagcggccagagcggatatcctaccagccctccggggaggtcgtgcgtctcaccaacgccatcaaccgggggctggagcacccggacgatccacaggagatcgtctccctgatcttgcagggggccgcggcgcggtacgcctgcttccccgacataacggaacaaatcgaccgcccgctggatgtgtgcttggaccatatccgtctggcggtttctcatatcaacttatcggaagaaggtacggtggaggcggcattcccatccggccaccgggaaaggacagaacatggagcagactgtacagcggcgggtgcggatcatccccgccaagagggatactgacaccccgcagccggggaaaaagaagcaccagagggtagcggcctactgccgggtatccaccgacagcgaggagcagatcaccagctacgaggcgcagaaagcctactacacccagaagatcgaggagaatccagactgggagctggccggcatctttgctgacaagggactttcggggaccagcatgaaaaagcgggaaaacttcaataagatgatcgccgcctgcaagcggggcaagatcgacaccatcctgaccaaatccctctcccgcttcgcccggaacacggtggactgcctggaaacagtgcggatgctgaaagcccacggcatcggcgtcatctttgaaaaagagaacatcaataccctcaccgagtccagcgagttcctcatcaccctgttcagcggtttcgcccaggcagaaagtgagtccctcagcaaaaatatcatctggggcaaagaggagagcaaaaaggcaggtaaggtgcccttccagtataagaaactgctgggttaccggaaagggctagacggaaagccggagatcgaaccgcaggaggcagagacagtgcggcgcatctatcggaggtacctggatggatgtagcctgtcccagatccagcaggagctggaggcggaccgtgtccccactgcccaggctgttcagcggtggtcgtatcaggtgatccgcaacatcctcaccaacgagcgttacattggggacgccatgctgggcaaaacctttatcaccgattgcatcagcaaacgggtgaagaagaacaacggagagcggggccagagctatgtggagaacaaccaccccgccatcatccccagggagctgttctaccgggtacaggaggagatgacccgacgggccagcaagcggaaggtgatgcagaaaactggcaagacggagctgggcaaatactcggccaaatacgccctctccgagctgctggtgtgcggggagtgcggaacgccctataagcgggtgacctgggccaggaacggaaaaaagcggatcgtttggcggtgcatctcccgactggaatttggaacgaaatactgccataactcccccacactggacgaagaaaaactgcatcaggccatccaggaggccatcaacgagtttgcccaggctggaacggaagtgaaggaggatatgctgacattcactgcaatggcctggggaggcgatgccattgatggagtcagtctcatcgacctgcgtcagaaactgaaggacatcaccgcccaacaagcactactgctggatcaggtgctggaacacatggatgacgagatcctcaatgctcagctcaaggcaatgatggacgaaaaacaggcccttcaggaacagatcgcggcagcggagcagagccagacccacaatgcagcccagaaatctcggatggcggaactgcgggagtggatggcgaaactggaggtcaaccagcagtacagcgatgaacaagtacgcatggcagtggaacggatcacagtggtggacgctgagaccatccgaatccgctttcggtatccaggggcggaactggagaaaaaactgtgatataattaggaaaaggagacaaatagaatggaactttacatcacaggagatacccacggagactttagccgttttcggcctgagagcttttatgagcaagagagactgacaaaagaagatgtcatcctggtcgccggggacttcggcggcgtgtggtacggcgacagccgggatgacgcaggcctgaacttcctggactcccggccattcaccacggccttcgtgtccggcaaccatgaaaactatgacgccttggctgcctacccccaggcggagtggcacggcggcagggtgcgaacgatccgcccctcggtgctgatgctggagcgtgggcaggtgttcgacctggggggcaggacattcttcactatgggcggtgccagcagccacgacatccaggacggcgttctggagccggacgcgccggacttcctgtggcggttccagtggctcaacgcccagggcgcggccttccgggtcaaccaccgctcctggtggcgggaggagctgcccagcgagtcggagtatgccgaggccagggccaacctcgaccgggccgggtggacggtggactacctcctcacccactgcggtcccaccagcatccagaacgatctcctggggccgctgtccaagccagatgccctcacagactttctggaggagatcggccagcggtgccagttcaagtatcacttcttcggacactaccacaggaacgagatcgttcggaaaaaatgtgtgctgctatacgagcagattatacggctgaagtagaaggaaacgtgtgatgtccatcacctgtttccttttagaaactaaaatttgaaaatatcttaagcattgttttttgcaggaggttatcgtatactcttattgggactatgtttggtcgtagtttagtcgaaaacactcagattaagcatttactgtagctgattctgttaataggagtaacatgtatgagtgagataaagattagagatttatacactggaaaaccggatgcaaaagacgaaataaactttgaggggttggaggagtttatcaagacttttgttgttgcagaccattttcaactcgattctctattatatggaaataattgctttattacaggatttaaagggactggaaaaaccgctctcctattttatttggacaacaagttgaaggacgaagatcctattacctgcacatcgtttatttttttcaaagaagagtttaccgatgctaagcgtgacgaattacaagcaatatccaatcggtttttatcatcaatttcagtagaacccggagctttgttaaatattagagaatttgaatatatttggcgatggttaatttttaagcgtattgtttcagataatgaggataatcatcgaaatctatttgttgatgatgaattctggggtgaatttgaaagaaaagttaatcagatcaaggcgcctttaaacaaaaagaagagcataattccgagcaaaataaagattgctgttccatataaggatccggccactttaaccgaattgtctccagaagttgaggttgatttgggcaacaataaaggtgctccgtatcagagttttatgttacttattgatgaagccgaagcggctcttgcaaaagtaaatagaacagatatcccttattatatctttattgatgaattggaagcatattacggcaatagacagatttttgagagagacttagcacttatcagggatctcatatttacagttaaacgttttaatacaatatttgcaaaatcacatgcaggcaaaacaaagatcatttgttctgttcgtagcgaaataataaatgctatctcacgatttattgtaacgaaggagatcaacaaagccacatcaggtttttctgtcccattgaactggatttatgcgaatacgagttcatatatgcatcctattattcagattgtattaaagcggatagccgtctgtgagggatttgaagaatgtaattataaagaaatttataatcggtggtttcctgaaaaaatacacggaattgagccagccaattacatcttgaataatagttggtgtaaacctagagatatggttcgtttgctgtctactgcaaaaaacgcacttcagaataacagcaaggtcttttcacaggcggtgtttaatagtcttagcaaagcttactctgaggaaagcttatctgaaatcaaagaagaattacgggccttatatgatcctactgaaatagaaacgataatcaattgtttcatggggtataagacagcattttcagtatcccaactaaagaaaagaatttccacatattatgcaggaactgttatagatacccattttaatcaggttattgaggatttgtatcgacttggctttcttggcaattttatgcccatctcaaaaatctatcgttggcagcacaaaggcgatgagcgcgtaattcttgcagatgagtggaggctttttgtccactatgctttgcatggagcattgtcgctgggcgctcgtttaaattttggattaactcgtggtgagcaacctgaaactggtgatgtagtgaatgctgttgtgcaaaaggtaattcgctcctttgccctggtagaatttactcacaacggagagtcctatttagggcaaattcatatttccgagttcactaaattagggtacggatatattgggaacctatccgagattgttcacatagatgacgaatatcgtactgcccttttggattaccatgaaaaatacgaacgatggaatctacagattataccacaagaattagaataaagtaagtcgctcaataattttgcttgcgttagaaaaataatcaggcatctatagtgttgtgatgttccacatcggagcaagctttgtatcgcttgctccgattttttataaaagtcagagcgcgctcattttgctgctccttctttccaaatcgcagccgcttgcgctgggttgcgatttggtatgccgccttacagacggttttgatagacctgcatctttttcgtcaacacatgacatgataagttgacaaacccaaaagccagaaaacggcttatatcaagggtttgtcaacttttcttttcgcttaaagtagtggaaaatggattttaagtgagtcgaaccctcttgcatttaaatatgaagtatagatgtttaggacacagcttcgggctgtgtcttttgttattcaaattgcaattatgaaaggaacatgataggatgaatacgacaaagagtgagcagatcaaagctgggcttcgaaaaagtttccaaactggggaatctgcaaaagcctccactgtgtgttacggatataaagtaacatccgaaggcaagttggtagcttatcccacagaggcgattattgtattccatatttttgaacgatttgccgatggagacagtctagggaaaatcgctgcttctctggcccgtatgaaggtgaaatctcccaccggcaaagagttgtggacgcgagagacaattagcaagattttgagtaatgagaaatatgtgggcgatgtgattttaggaaaaacgcaggtgcaaaatggcgtgcaggtcaagatggtcgatcacacttctcagacagtcataaatggtcatcatgaggcaattatctccagagaactatttgatattgtccaacaagaaaaagcccataggagcaggctaaaaagtcattctcatgtagtgtaaactttaaggggaaaatcatgtggtccgtcagaacaataccaccaaataatctcgtccccacgcagctaaaggtggcggcatactgccgtgtcagtacgaacagcttagagcaacagaccagtttgtcctcacaggaacaatactatgaggaatggattaagcgaattcctcattggacattcgccggtatttattccgacattggaagcgggacacaggcgaagggacgccgtagatttaatgcgatgatatcggcttgccggcggggaaagatcgatacgatccttacaaaatcggcacaccgttttgcccgtaatactgtagatgcgttggaaactatacggatgctgcgacggtggaaggtcgacatttattttgaaatagagggaatccattccctctatgaaagttcggagtttcttctggcggtagtctgcgctagagcacaggaagaaagctattccaaaagcgaagatatcaaatgggggctgagaaaagcatttgagaacccagagtctaggtattatcagagattctgttatggatacactcataacaaagatggccgactcgtaatcaatgagaaggaagcgcaaatcgtccggctcatttatgagatggccggtgagggtaaaagtctctcaaggatatcctctcgcctaaaagaaatggggattccttctccgagaggcaaggagacatggagcagggaaaccttgcgaaagattttgaaaaatgagaagtatacgggtagtgtgatattgcaaaagacctatgtaaaaaattttctggaacacaaacaagtacaaaatgaaggacaattggatctatatcagatagataacaatcatcaaccgattattgatgatagataaagatggtagtatagtctcttttgatagggagtgcaaagacgggatttttgtagattgaatgattttattgctaaattttatcatgccatattgtagtaacatctacttcaaaggagagacagtatgcgaataataggaattgatattcagaattttcgaaaactatttggatgtcacattgatatcagtaaagaaacaactctgtttgtgggggcaaataacagcggaaaaacttcagcgatggatgctcttgcaaaatttttagcaaatcgcagttttgtttttaatgacataaccattgcaaaacgtattgatataaacagaataggaactaaatgggtggaagcggattgcgagtagcctgctgatttattagattgggatactattgttcctaaaatggatatttggcttgatgtggctcctaatgaaatgcattatgttgccagcataattcctaccttaaaatggcgcggaggaaaattgggagttcggttagctctcttaccaaaagatgtttctaatttatttaatgagtatcgagaagcgtactcttcagctcgcaccacagaacatgcaagggttgaaaaaagttctttcaatctcttcccaaaagacttgtgtgaatttcttgatagaaaattgactacatatttttctatcaaggcatttatccttgatccgtcacatttcgaagatgcccctgtacaaccaacatcctttgaggcagaatgtttaacagataacccactaaaggacatcgtaagggttgacatgattgacgcacaacgcggatttgcagatcctgacagttcagaaggaacagaaaaggttcggaaacagttatctgcccaaatgcgcaattattatgaaaaacatctagatccagaaaaggctccttctccagaagatttagatattttagaagctactgaaggcgcacgccaagtttttgataagacacttgcattaaaatttgctcctgcaataaaagaattagaagggttgggttatccgggtattagtgatcccaaacttacaataacaactaaagttatgactagcgaaacattaaaacacgattcagccgtacaatatgcgctcagtaaaaccgacaatactttgaaactaccagaaaagtataatgggttgggttatcaaaaccttatttcaatggtttttgatttgatgggttttagagatgactggatgcgtgaaggaaaagctaaagatactaataccgtaattgagccgatgcatttggtgctggtagaggaaccagaagctcacctccatattcaagtgcagcaagtttttatacgccaagcatataaagttttaactaaccataaatttctcaagcaaaacttgaattttacaacgcaattggtgatcagcacccattcgagccatattgctatagaaactacttttggaaatttaagatatttcaaacggctaccagaagggactgaatgcgcagtagcgacatccaaagtaattaacttatctgatgtatttggggattcagatcagaccaacaaatttgttacacgttatctgcaatcaacccattgtgatttgttttttgctgatgcagcaattctggtcgaaggtgtagccgaaagtatgctattaccacattttatacgctcaaagtttccagaactatatcagcggtatattacaattcttggggttaatggacgtcatgctcaccggttaagtcctctgattgaaaagttatgcctcccaacattggttattacagatttagatccagcagaaaaagaaggttatcacaaatctgtagttctcaagagaggagaaggccaaatcagtggaaactacgctattgcaaagtggctgatgaaagaaaaagacatcgacaagttggtagattattcagaagataaaaaggaattttcttttgcttctccgtatcgattttctattcgtttagcctatcaaactcctgtaaaagtggactttgaaggagaagaaaaagaggccatacctggaacttttgaagattgtcttatatatacaaattatgatcttttcaagaagataaaagtcactgattctgggaacttggttgaacaaacgcatgatttacttaactctaatgacacattcgaaatgatccatgaaaaaatttataaaatgctgcgtgcaggaaaatcagagcagaaggcagaattcgcattagacgtaatttttgaaattagtccagacgagctttcggttccaccatatattaaccaaggtttaatgtggctacaggactatttacatccggaggattaacgatggataaaataaaagaggtaaccgaagaattattagatgatcatgtagatgaccatgtagatgaagaaattcagagatgctttttaaaagaagatccaaaatgtttctttgtttttgcgggagctgggtcagggaaaactcgaagcttaataaaaaccttaactttcttggatgaaacactaggtgactggcttctaacgaatagaaaacagatagccgtaattacttacaccaatgcagcttgcgatgaaatatccaggcgattacattacaagtcgattttctcagtctcaactatacatagtttcttgtgggagcttattaaaaactatcagtcagatatcaaagcgtgggtaatcaattcgataaaccttgaaatcgcagaacttgaagaaaagcaaagaaaaagcaaaacgggaaaaacttcagaaaaacgagcagaggatatacgaaaaaagcaagagcgactagctaaaatcaatacggtaagaaggtttacctataatccaaatggagataatgtaggatatgattctctcaaccatagtgaagtagtaaaaatggggtcgaaatttatctgtgcagaagatactatgcagaacattttgatttcccaatatcctattctcctcattgatgaaagccaagatacaaaaaaagaactggtagatgccatttttaccgtatgcgaaaggcacaaaggaaagttcatagttggcatgtttggggatacaatgcaacgaatctatcaagatggcaaagaaaacctttctcagtgtatccctgatgactgggtaaagccccaaaaaatcatgaaccatcgcagtgcatctcgaatagttactttggcaaatgccataaggtttacagtcgatactcaacaacaacgccctcggtcagacgcagaggtgggaaatgtaaggttgtttatcgtttcttcagatgctaataaagaagtgacggagcagcgagttgcggaaatcatgtctgaagaaactggtgatggtgagtggcgtgacagtaaacaatataaaagtctcatactagaacaccatatggctgctagtcgctttggctttttagaactgtatttaccacttaatgaggttcctgtatttaacacatctttgcgagatgggtcaatttcagaactttcttttctgtcaaaagttatatctccgcttgttcaggcctataaaggcaataatgactttgaagtactaaaaatagtcaaagagtattctcctttaatggaaagcaagaaatggatttctcttgacgatcaaacaaaagcactgcagcaagtcgaaagtgctgtagataaattgatggaactatggaaagatgatgctattccaacttgcttggatgtcctccgctcaattcaagacacagggctatttaaactggatgaacgtgtagataacatattgtcatctcctgccgcagacgaatctataaggataacggctttaagaaaggctctatctgtcccatttaccactttagaaaaatattttgcatatgtctctgataatacgaggtttgcaacacatcagggtgttaaaggcttggaattcccaagagttatggttattatagatgacgcagaagcaaaaggatttctttttagttatgaaaaactttttggcgtcaaactaaaaacagaaactgatatcaagaatgaaagagagggtaaagacaatagtataacaaggacaacccgtctgttttatgttgcttgtactcgcgcacaaaaaagtttggctataattgcttatacatatgactgcgaagcagtgaaagcaactgccatgaaaaataattggtttgaagatgatgaaattcgtcttttggagtaaggcaataaaagccgttgcagaagttattagactgaaacgcttccaaaatgcttattctgtttcgttgcaaagcttttgaaagtgtgcatcttttttgtccacacatttcattcatagaaaacgccgcagtgaaaactgcggcgttttctcgtttgaccacagaaataccacagacggatttctgctttaactacttgacgggtaccccctttcaggagtgcccgtcttttttgtttgtgccaatactgtttagcgcctcccaactaatctcgttggaagttgccgctatctctcaaacagtcgcattttcagcataaatcttctcttatattttctgagaatatttcttgaccacaaatttgcccatagacagaaaaaatcagcccgccggatgggcaccttccatcggcgggccggttttgcaacatttcagcttgctttgcgactccatcgtttccttgcttggaagtttgtcatggaatgttctctccgctcttctggttgtttgacctctgctttcgcggtatcacggtcaatcttttccgccgccaattgctgcatctcgtcggttatgtgggaatatgtgttcagggtagtagcgctggatacataacacaaaattgtcggcagggtcttgatgtccattccgtaggcctaggcgttggttgcaaaagtatggcacggaccatgaaatctcacccgttcacatcccgcataatccaaaattctgtgcaggcgcttatggggcgaggatggacgcatgggcaagtcttctttctttggggatggaaacatccatcgtgaatccaccttggtcttatactctgccagcactcgcctgacggatggcggcaggatcatggtacgaaccgccgcttttgttttgggttcacagatgactacctctgatccgacaatgctagcttgcttgtcgatccgcagctctccagtcgttaagttcaaatcgtcccactgaagggcggccagttccctcagtcgcaggccagtggcaaactccagagggaagagttcatagtaattttcctctttggcctggatgagtactctctgcatagtttcccctgagggaattttcatctcttctcgttttgcaggcggacacttgcatccaatggccgggttgcagaggatcaaatgctcctcagctgctttctccagtgcctgccggcatagactgcggcaacatcgaatctggctgtcagcaataccttttccattggcatactcatctggcttcatccacacacaaatttgctgcttatcattttctgttagtttgttcagtggaatatcgcctagccttggtttgatgtatagccggagatacccttcgtaggttcgatgggttctgggccggatttatggtttgctgtaggtttcgtaccaatagttcagacacttcccaaatggcatatctgcccgaaccttggccggatttgcaggtgcaatggtgtctttcagtgttttcaatttatccacgcactcacctttggtcttggccagcacatttttcgtcttgggaaggccgtcctttctcagctgggcggtgccttcgccgttttttcgctttcttcccatagcttcaactcctcttcaaagatatttttaagaaattcctctacgatctcagccgcccgcttttgtatatccctagtggtgtgggtaggtgtcttgggtgaacgccgacctggtatgtcccaggattccagacagagtctttacatctacaccagatgccaacgcatgggtggcaaaagtgtggtgcagaccatgaaaccggatatcaggcagctccgcccgttttaacagggctttcagccgatcataggcagtactcgggtgggtaggctgttctggtttccacggatgggggaagatccattccgtcagagcggactttttcctctcccggagcaattctacagtactgggcggcagggtgatcgttctggcaccagctgatgtcttggtatcccaagtagtcagttttccgccacgctcctcatgtacagcgcggcaaatcttgagccttccatcatctgcatcaaagtccctccactggaggccgcagatctcacctcgccgcagtccggttgtcagttctgtatagaagaagtcataccagacggcatcctcccggataatctccacaaatcgttccaactgctcatccgttaaaatttgttttgcctcccccagtgcttcatggagcatggagtgaatcccacggacagtactcctggcaagcactctcctgtggttcggtttccctgacgagccagcgtatcatataactttttaatgtcttttccggttatctgagtgattggcttgtctcccataaaggggacaatgtggttccgcacagtaccttcatatcgtctcaaggtagagggacgaatgttaggagccatgtttttcaaccattgctccagccactggcccagtgccatccgactctcctcagtcagctcgacactctgatacacctcaatactctgccggagcttaactgtcagttccttctggatatcagtatagatatagcggaagatggactcaccgttctctttgtggcccactacgggatgtgccttgaaattagggacgactggttcacacacgtagtccctcggacaccgttcggcgcacatcggcccggctgtggctgagcccccctggatcaaaggcagggcagtcttataacggatggccttgcagcggagctcaccggccatgtccaaagtctcctgtatctttcagctttcgtggccgttgaccgtctctttgaaaagtatctacgcaccgtgctctgactgcgccgcataagccagcagaaaaaccaacctcctggatttaatttagaagttatccgacaaaaagtgattcccgcacaaaaaacacgccctatgccgtccgaaaatggaatggcatggggcgcagctttattttataccggccgagcataggcggaactatggtcggccccggcccttgccgccggtggctggatgcggaggacagcacgtcctcccctctacagactcatatggctggttttccatctcaacacaaatatcaaaaaactgtgaggataaagataactggaatgcaatatgtactcagcgctccctttgttccgggagaggaatcaccgagttgtttgccaactcaatccgaaacgcatatttatcgccgcggacaatggattttgtatattcaatcaggacattgccctcatagctgtatcgctccaaaagagtacacggaacattggatgagatatgcaacagcgttctttcttctgagcgcggcataacaggccggaatttttccgtggcccgatctgcatggaagttatactgttctcgcaaaaactcatatagagagccgcaggagagcgcctccgtgtccagcgtcaagaaacggctttgggggagaaaggtggtttccagcatcagaggatacgtcctggccgagcggagccggagcagtttatggaacaccgttccctcctgatacccggtttcaatcgccaaagacttatcggctttgaccagatcatagtgaatgacagaattctgaattagaatattgctgcttttaagcgtatcagtaaacgagtagaaatcagataggggctgggtaaatacgaacggcttaatataggttccattaccctggaccgagtaaagtacaccggtttctttcagcatgttgagtgcacgccggagagtgctacggcttgcgttatacttccggcacaacttttcttcgggggggaacagtgaattttccggatagagccccgtctgtatatcacgaagcatctccgtgtaaacgtctatatagaccggcctttgagccataccgcaccccccgcttgccgctgcttcacgtcacttcagatagccaatcgccccatagatccttacaagtatttttagagactattactatttttccaattattttatcatatggggagtgaatttacaaggaaatatttccctgttaaaaaaagagatacaactcaggtcagttgtatcgattcaaaatgcatacaactgagggtagttggcctattttacccaaaaccatagacaaaattagcaaaaaactatacagtatatacagaagtagccgatccgcacgcgttattacagttaaaagtaccacatggaggagccaatatgaagcaatggtatgtcggggtagacggcggaggcacaaaaaccgccgtcgcgatctccaccgctgacagtgttccgatccaaaccatgacctacccgacctgttcctatcagtccatcggtattccggaatccgttgccctgatcacgaaggtggtacgggaggccctctccgggggcggggtaagcccacaggattgtgccgggtgttgcgtgggtatgccctgttatggcgaaaacccagcaaatgaccgggagatcgttcgcctgctgacagatgctctgactccagtcccagtgtatgttgtgaatgacggtgaagttggctgggctggatccctcgcctgtggggagggaatccatattgtttccggcacaggttctatcgcatttggacgcgggtgtgacaaagaatttgcccgctgcggggggtgggtggagttttttggggatgagggctcctgctactggattggtcggcagggaatgagtctgttttccaaagaggccgatggccggttgccgaggggtccgctctatgatctagtccacggggagtttggcctgacggaggactaccagtttattgatcggattgtccgggactttgccccctatcgggaaaaagtcgcggggttccagcggtacgtcctacaggccgcccgggctggcgacacagccgctgccgcgctgtatgaaacggctgcgcttgagttggcgctcatgattcgcacgctcaagacaaaacttcgtttctccgccgagccaatcagcgtttcctactccggcggtatcttccatgccggagaattcatcctggcccctctccgtaaaaaggccgaagagctgaactgcatactttgtgaacccaaatactccgcgaccgagggcgcgctcatgttggccatggaacggttccctttatcacccagttaaatgtccgaaggagaatgatgttatgtttttgaccgaagctgagattctggataccccgctgtccctgaactacacctgccaatactttgagaagaacaaaaaaaatctggagcagttcttccaggaaaaccagcaaaagaagtttaccattttgggctgcggctccagctatatgctggcgaagagcacagcatctctgtttgcgtcgctcccgggaaccagcgcaaatgcgatcgccgccggcgactacattgtggaccctctgttctggtatgagacggtgaagggcagcatcgtgctcctgctttcacggtccggaaagacctctgaaatggtatgggccctgaagcacatcaaagaggctcacggatgtccagcggtgtccatcacaacggaggatgggaatgatctgatgcccttgtgcgacctgaacctgacgctgaactggtgccatgatgacagtgtctgccagacccgaactgtcacgaacctgtatgcctccacactgcttctggcggcggaatacgcaagggatgaccgcctccgagagagtgtcctggcagccatgcgggagagcacctcgtttcagctgaagtaccggccggtgctggccgagatcgcaaaccttgattgggacaatgtggtggtgctggcggacggccccatttgcggcatcgcggaggagggcgccctcgcctttaccgagatctccatgctgacaggccgctatttccatctgctggattaccgtcacgggcctatcgtggtcagtggaaaacggactctgactctcgcgttgctgcggcccggtgaagaaaagctccaaagcgctatgatgaaagatgtgattcagcgcggcggccctgtggtcacgatttcccactgcacagaaaataggtacgacgcggcagcccatattcagattccggaagtcggcgagttcgccgcatggggtattctgttcatctatgtcgcgcaaatgacagctctgctgaaagcaattgccctaggcggaaaccccgaccagcccaagggcctggacgcctacatatccctgtaaatttttcttacaaggatcgtttgccttgtctgagagaaacgatttgaaaacagaggggagaggatagctccaaatatgaaactgccggagcaggcgtcgttaacaggataaggacggactacaaaggaggaatagaagggatatgagaaatcgaaggaaagctgtttcgcttctaacgggcctactcgtgacggcccagttatttccaaccgcggcgcttgcggcagactccagcgagtccgcattgaacaaggcccccggatatcaggattttcccgcctattacagcgacagtgcgcatgccgatgaccaggtgactcacccggacgtagttgtcctggaagaaccgtggaacggctatcgctattgggccgtttatacgcccaacgtgatgcggatctccatctacgaaaacccgtccatcgttgcctccagcgacggagtgcattgggtagaaccggaggggctttccaatcccattgagccgcagccgcccagcacccgctaccacaactgcgacgctgatatggtctataacgcggaatacgatgccatgatggcctattggaactgggcggatgaccagggcggaggcgttggggccgaagtccggctgcggatttcctatgacggcgtacattggggcgtccccgtgacttatgatgagatgacccgcgtatggtcgaagcccacctccgacgcggagcgtcaggttgcggatggagaggatgacttcattaccgccattgcttctccagaccgctacgatatgctctctcccactattgtctacgatgacttccgggatgtgttcatcctgtgggccaacaataccggcgacgtggggtatcagaatggtcaggcgaacttcgtggaaatgcgttattcggacgacgggatcacctggggtgagccagtccgcgtcaacggcttcctggggcttgacgagaatgggcagcagttggccccctggcatcaggatgtccagtatgttccagatttgaaggagtttgtttgtatttcccagtgctttgccggccgaaatccggatggctctgtcctgcacctgaccacatcaaaggatggagtcaactgggagcaggtgggcaccaagcccctgctgtcccccgggccagacggcagttgggatgatttccagatctatcgctccagtttttactatgagccaggcagttccgccggagatggtaccatgcgcgtctggtacagtgccctgcagaaggacaccaataacaagatggtcgcggattcctccgggaatctgaccattcaggccaaaagtgaggatgaccgcatctggaggatcggctatgcggaaaacagttttgttgagatgatgcgcgtgctgctggatgaccccggctacacgacgcccgccctggtttccggcaattcccttatgctgagtgctgagaccacttcccttcccacaggggatgtcatgaagctggaaaccagtttcgcgcctgtggacacctctgatcaggtcgtgaaatatacctccagtgatccggatgtggcgacggtggatgagtttggaaccattacaggcgtttctgtcggttcagcgcgcatcatggcggagacccgggagggcctgtccgacgaccttgaaattgcagtggtggagaatccgtacacgctgattccccagtccaatatgacggcaaccgccaccagcgtctacggcgggacgacggagggccccgcctccaatgtcctcgatggaaacgtccgcacaatatggcataccaactatgctcccaaagatgaactgccgcagagtatcaccgtttcctttgaccagccctataccgtcggccgcttcgtctataccccacgtcaaaacgggacaaatggcataatttcggagtatgagctatacgccatccaccaggacggcagcaaggacctagtcgcctccggctcagactgggcgctcgatgccaaggataaaaccgtgagctttgcaccggtagaagccgtcggcctggagctcaaggcgattgccggcgcaggtgggttcggtactgccgccgaactcaatgtgtatgcgtatggtccaatcgagcctgcgcccgtatatgtcccggtggatgaccgggatgcttccctggtgtttacgggtgcatggaatagcgacagcaacggaagcttttatgaagggacggcccgttataccaacgagatcggcgcgtccgtggagttcacatttgtggggacggccattcggtggtatggtcaaaatgatgtaaatttcggcgctgcggaggtatacgtggacggcgttctggcaggggaggtaaatgtgtatgggccggcggcggctcagcagcttctatttgaggcggacggtctggcctatgggaagcataccatccgcatcgtctgtgtgtctccggtggttgacttcgactatttttcgtatgtgggagaataaagcgattctagcaggcgactttcaacacaaaggattatagagaaggaggactcggaaatgcgtggtaaaaagttcatatcactcacgctcagtacgatgctgtgtctgcagctcttgcccaccgcttcttttgcggcggcgcctgcaacggacaccggcaacgcaggactgattgcagaaggtgattatgccattgccggcaatggcgtccgcgtcacttatgacgcggacgggcagacaatcactctgtaccgcacagaggggtctgggcttatccagatgagcaagccttctccattgggagggccagtggttggagggcaggaggttcaggacttcagccatatttcatgtgatgtggagcagagcaccagcggagtgatgggcagcggtcagagaatgaccattacctctcagagcatgagcacgggcctaattcgtacctatgtgctggagacctctgatatcgaggagggtgtggtatatactgcaacatcctatgaggcaggagcttctgatgtggaagtgtcttggttcattggcagtgtgtatgagctttatggtgcggaagatcgtatctggagttataacggcggcggtgaggggccgatgcactactatgatacgcttcaaaagattgacctgaccgactctggcaagttcagtagggaaaataaacaggatgacacggctgcaagtattcctgtgtcagatatttacattgctgatggagggattaccgttggcgatgcttctgcaaccaggagggaggtacatactccggttcaggaaaccagtgattcagctcaagtttctatcgggtggccaggcaaagtcattgccgccggaagcgtgatcgaaattggtgagagctttgctgtagtccatccgggtgactattataacggcttgagaggttacaaaaatgcaatggatcacttgggcgtgattatgcctgcacctggggatattcctgatagcagctatgatctccgatgggaaagctggggctgggggtttaactggacgatcgacttaataatcggcaaattggatgaacttcaggcagccggagtcaagcagatcactttggatgatggttggtataccaatgcaggagactgggccttaaatccagaaaagtttccaaatggagcctccgatgcgttgcggctgacagatgcaattcatgagcatggtatgactgcactcctttggtggagaccttgtgacggcgggatcgatagtatactctatcagcaacaccctgaatatttcgttatggatgcagatggaagacctgcaaggcttcctactcctggtggtgggaccaatcccagcttgggatatgcactttgccctatggcggatggtgcgattgcaagccaagttgactttgtaaaccgtgcaatgaatgattgggggttcgatggcttcaagggagattatgtgtggagtatgcctgaatgctacaatcctgcacataaccacgcctcgccagaagaatccactgaaaagcaatccgagatataccgcgtctcttatgaggctatggtggccaacgaccccaatgtgttcaatttgttgtgcaactgcggtacgccccaggactactatagtttaccatatatgacacagattgctacggctgaccccacttctgtggatcaaacaaggagacgcgtgaaagcctacaaggcactgatgggagattatttccctgttacagccgaccacaataacatctggtatccaagtgccgtcggtacgggctctgttctcattgaaaaacgtgaccttagcggtactgccaaggaagaatatgaaaaatggcttgggattgcggatacagttcagttgcagaaaggccggtttattggcgatctttacagttatggttttgacccttacgaaacctatgtggtggagaaagacggggttatgtactatgccttctacaaagatgggagcaaatatagccccactggctatccagatattgagttgaaggggctagatccaaataaaatgtataggattgttgactatgtcaatgatcgtgtcgtggcaacaaacctgatgggtgataacgctgtattcaatacacgtttttccgactatctactggttaaagcggtggaaatttcggaaccggatccagaacctgttgaccctgattatggtttcacctctgttgatgacagagacgaggctcttatttacacagggacatggcatgatgacaataacgcatctttcagcgaagggactgcacgttataccaacagtacggatgcttcggttgtattctcctttactggaacttccattcgctggtatggccagagggataccaattttggcacggcagaagtttatttggacgatgaactgaaaacaacagttgatgcgaatggggccgcagaagcaggcgtatgtctttttgaagcgcttgatcttccggctgccgagcataccattaaaattgtgtgcaagagcggagtgattgatattgaccgctttgcatatgaagctgctacccttgaacccatctatgaaaaggtcgatgcgctctcggatcggatcacttatgttgggaattgggaagagtatcacaacagcgagttctacatgggaaacgcaatgcgcacagacgaagccggcgcttatgctgaactgactttccgtggtacagccgtacgcctgtatgcagagatgagcttcaattttggcactgcagatgtctatttagacggagagttagtggaaaacataatcctatacggccaggaagcaactgggcagctaatgtttgagcgtacgggactggaggaaggagaacataccattcgccttgtacaaaacgcctggaacatcaatttggactatatttcttatctaccagagcaagatcaaccaacgccgccggagacgacggttactgttgatgcaatggacgcccaactggtgtatacaggcgtatggaatgatgactatcatgacgtctttcaggaaggaaccgcccgttatgccagtagtgccggcgcctcggtcgagttcgaatttactggaagcgaaatccgttggtatggacaaaatgattccaacttcggtgttgccagcgtttatatcgataatgagtttgtgcagcaggtaaatgttaacggagctgcggctgtgggaaagcttttgtttcaaaagactgatctaccagccggttcgcacacgatccgcattgtgtgcgatactccggttattgatttggactatttgacttataccactaacgcataatgtttcattccaaataaaataggaggttactcatttggataaaattacatttcttggcgcaggcagtaccgtctttgcaaaaaatgttttaggcgactgcattacgacggatgctatgcgcgagtttgagtatgcgctctatgacattgaccatcagcggttggaagagtcctatatgatgctttctaatattaaccggaactctaacgacggaaaggctaaggtcgtcaaatatgcagaccggctggatgctttacgtggagcaaaatacgtcattaactgcattcaagtgggaggatatgacccctgtacgattacagactttgaaattcccaaaaaatatggactgcgccagacgatcggagatacgcacggcatcggtggaatgttccgggcactgcgcaccatccctgtaatgttggactttgcgaaagacatggagaaggtctgtcctgatgcactcttcatcaattatacaaaccccatgtccatgctatgcttggcgatgttccgagccagttctgtcaatacagttggtctgtgccactcccaccaggcctgtgtacctgaactcctcgccgagcttggcatgccctgggacggcgtttcttacaagatttcgggcatcaaccacatggcctggctattagagattagccgcaacggcgaggatctctatcccatcatccgcaagcgtgcccaggagggaccaatttacgcccccacgcttgcattgcgtgagttacatcctgagtatgcggacagaattccgtcagtggccgagcagtttactcctgataatcatcatgatatggttcgcttcgaaatcatgaagcagttcggctacttcgtcacagaatccagcgagcacagcagcgaatattacccctggttcatcaaaaaggaccatcctgagcttatcgaccgctttcacatccctctggatgagtacccccgccgttgccgcgatcagattgcgcggtggaagcagcaggccgagcatctggtccacaatgagaacctgacccacacgaggagcagcgagtacgccgccggcatcatcgaggcactggagaccggcagaacctttggatttgctggtaacgttctcaatactgggcttattgacaacctgcccttcgatgcctgtgtggaagtctcctgtatggtaaacgagggtcatctctccccctgccacatggggccgcttcccaatcagctcgccgcgctgaatcggcggcagatcgaggtgcaccagctcaccgtagatgccgctctcaccaggaagaaggagtacatctatcaggccgccatgctggacccccatgccgggagcgaactgaccatcgatgagatccgcagccttgtggacgacctcatacaggcccacggcgactggttgccggagtatcattaaataaatgcaagagccacagggacccatgccaaggttattcgcgcttgccccgcaactcgttgaggaagaaacaaggagggaaattttgtgtctaccgaagtcgttaaggaagctaaattagaggaagaaccaaggcaatgtaccaagaaggaaaagctcggccacgcaattggtgtactcgggcatgattctatgtataccttgtggtctacctggactactccgtttttaacggatattctaaagctgcccgccggcttcctagcgttcctttttggtggggctcgattctttgacgcctttaccgatatctctatgggtatcattgcagaccgtactaggagtaagtggggccggtttcgcccgtggcttctccgctcaggtcctcttatggggatctgtttagcactctctttctttaagcccgatatcggcaccatcggactgtgcatttttgcaggtattatgtatatcatcacaggcagtattgtgtttacctccgtggatataccattctggagcttgcctgcggccatgaccagcaatacgaaagagcgctcggaaatcgttggcttcactaccaccgcgtccaataccattactggaattatcggattagtgatgccaatggcactggccttctttggcgaatttgactggcatgtttactttttccttgcacttgctgttgccgtctggggtgtgaccatgtacctgatttccttcaagttggtacgggagcatgtggtaccagacgacagtgagaagtttgagctcaaactggcactaaaaaatatttttcaaaacaagcccttgctcctgatccaaatctcaaatatcttttgcctgctaggtatgatgctgaaaggctatctcaattattattattgtgtatataactggggcagcctgggttatatgactgtgctgaacttaattaatctggttggtatggttgtaggcgcattgatcttcacctttctctctcagcatattgggaaaaagaattgcatgtttctctttgccgggctcatgacaatatccagcctcgttctctactttgccgggtatcataacgctattgtactttttgccacatcttctgtctcaactgtatgcgttggagctgtcatggtctgtgtcaacgcgatgatgatggatacaattgagtatggcgaatggaaaaccggccagcgcaatgaagctatgattacctctacccgttgcttcgtgaccaagtgtgtcatggcagtcgcaggtatcgctgttgccgctgtaatcggtctgactggctacattccccaagagaccgtacagccggtgaacgtattaaattctttccactttgtatatacgctagtcagtgctggaattataatccttgcagttgtccccatgctgttctataagctgaccgagaagcgccacgctgagatcatggaggagttggccgcccgcaaagccagcaagacccaatgaagaagttcttaaattttatcgtctgaaaacagaacgtgccaatggggcacccggcggctatcgccgggtgccctctgtgcaaaaggaaaggggaagctatgaccaatctacaaattcaaaatccgatttctgaactcttgcaaaagcgcggacagaatcgtgaaatgggcctctattcttgctgcagtgccaacgagtatgtaattcgggcggcccttcgccgggccaaggaccgtgatacggtggtgctggtagaggcgactgcaaatcaagtgaaccagaacggcggctataccggtatgaccccggtagcgttccgggcgtttctgaaccgtttagctgaagaggaaaatttcccgattgacaaactgttctgcggcggcgaccacctgggtccgctgacctggacccatcttcccgaggctgaggcaatgaaaaacgcaggggaactgatccgctcctatgtactggctggcttttccaaaatacatattgataccagcatgtgcctggcggacgacgctcccaatgagcggttatcggatgttgtgatcgcccaccgcggcgcccaactctgccgtatcgccgaggaagcttttgcccaatacagtgcgtggcacccggaagcccctgcgccggtctatatcatcggcagtgaggtgcccatcccaggcggcgcccaggaaaatgaggacagcgtaaccgtaaccgcgccggaggactgcgaagccacgctgtccacgttccaggcggcgttctgctccaatcatttggaggcggcatgggagcgtgtggttgccattgtggtgcagcccggggtggaatttgccgacgaaagcgtgatcgaatatgaccggacggccgcccacagcctgacggagcatttaaagcggcaccccaacctggtctttgaaggacattccacggattatcagccgcggcaatgccttcgaaagatggtagaggacgggatcgccattctcaaggtcggaccagctctgaccttcgccctccgggaaggactgtttgccctggagcagatcgaacgggaattgtatgggatgatggatttcccgtgttcccattttcgtgagatcctggagcaagtcatgctggaggaccagggccagtgggccaaatattatcatggctctatgccggagaagcggtacgcccgggccttcagctactcagaccgggcccggtattacctgaccaacagcaaggtgcagggtgcgctccgcctcctgctggataatttgaacacagcaggcatcccaatggccctgatcagccagtatatgccagtccaatacgccagagtccatgtgggtatattgcctcccaaggctgaagacctcctgatggaccgtgtgggggactgcatcgacgactatctctatgcggtactcagggactgaagcaaatctggagaaagcaaagccttgaatacggaaagggtggaaatattatatggcactggtaaacagcagaggacttttgagggatgcccgtgcaaacggttatgcggtaggcgcgttcaatgtagaaaatatggagatgatgcaggctgtcatcgcggcggcggaggccgagcacgcgccggtcatacttcagacgacgccatccacattaaaatacgcggagccagcagtcttcgcggccatggcccgtgctatggccggtaaggcgtctgtgccagtggctatgcacctggatcacggagaccggtttggactatgtcagcaggccgcgtcagacggttatacctccctgatgatcgacggctctaaactgccgctggacgaaaatatcgccctggcccgcagagtggtggagatggcaagcgggatgtcttcccggccttgtgtggaagcggagctggggaaactgggcggtaaggaggatgatctggaggtcaagccaggtgaggatctttacacagatccaggcgaggcggcccgtttcgtccgggaaacgggaatcgactctttagccgtagccattgggaccgcacatggtttctacaagggcaagcccaggctggcctttgagcggctgactcagatccgggaagcggtagatatccccctggtgctccatggctcctccggtgtcccggacgaagatgtgcagcgtgcggtatccatgggtgtgtgtaaggtcaacttcgccacggagcttcgggccgcctatacccaggcgttacgggactgtctggctcatgacgccgcgctctacgatcccaagaaatatgggggccccgcgcgggaggccgtcatctctctagtgcggcatcgtataaaaatttgcgctggtaaagtcggcttgattgctcccttgtaagtatatatgacctttctttcctaatgcatatcgtattcttttggtggtaaaggtatttcaatctgccgcctgtatcatgcaaaacgaacagagcccgcatagcttttctaaattgcggaaagctaaacacaaccaatcggaaggggtgatatgcttgttcaagcacgaaaaacaactgtttcatccagtagaagtggagcagcccaatcctcagtatgccgcactattgcaggagcagctcggcggcggcaacggcgagctaaaagctgccatgcaatatatgtcccagagtttccgcatcagaaaccccaagatcaaggatctgtttatggatatcgcggcggaggagctgagccacatggaaatggtagctcagaccatcaatctgctcaacggtcatgacgtggaagcagacaaggtccaggcaggcgagatcgaaacacatgttttgcttggcttgaatcccggtctcatcaacgcctccggctattcctggacagcagactatgtcactgtcactggagatctctgcgcggatctgctgagcaatattgcctccgagcagcgggccaaggtagtatacgagtacctctaccgccagattgaggacaaaaaggtacgggaaaccatcgacttcctgctcaaccgtgaggaggcgcacaaccaaatgttccgggatgcctttaatgaggtgcaggacagcggctccaatcaggacttcggtacgactaaggcggcaaagatgtatttctccctgtccaaccccggccccaatgcattcgcgggaaatgaagtatccgggcccaagtttgcaaaataaaaagcggcaggggccgtgtggtcaagagttcttctgctttataaaccattctttcccttaagcccttgctccgcagggtcttaatgggtgcatttttatcataggccaaaacaagagccgacttgtcaaacaagtcggctctcgttttatatcctgcgcccgtttgtcattccgcctcccgcaggcgctccaccacggtgtgccgggcgatggagcggtaggtcagcagggggatcaccaaccccaggaccacgaagatggggaaaataagcaggatgggcgccagggtgaaacggtaggtgaagaaccagaacaggctgttcacggcggtacccagcagcggccccatgaccacggtgaggagcagagaggccagcacggccgccagggtgtagaggaggccctccagcaccagcatcttcttgagctgcccgccggtcatcccgatggactggagcacggcgaactcccgcctgcgggtgatgatgccggtgagcacggcgttgaagaagttgagcacgcccaccaggcccacgatgaagctcagcgccccgcccagcatcaggaacatcccccggaagccctcaaactctgcggcgtaggtggccttgctctcgtaatcgagctgggggttgacgttctccgtgtagtcccggagaaagccctccatatccgccgtcgcgccgtcgtccacgtcaaaggcgtagtacatgatatccgccgtgccggtgtcctggaggaaggtctggtcgttgaggataaactcgtcggccccgtaatagcggtagctcagggcggtggggacgctgaccaaggctgccacctcatactcgaggtcccggtacttcaccgcccgggcggcaaagggcgcgccctccggaatgtcctcctctccgccgtacacctcgccggtgttggggttgtagtactcgtactcctccacgtgccgcagtgtaattttatccccaaggcgggcccagtggctgtccatccgcgggctgccgtagtcgtcctcggagtacacagcggccacgtaccgcccgcccggctcgtagagcttggagatatccccctccagcacggtcaggcggtccagggcaaaccgctccataccgtagagctgggcccggtcggccagcaggccgtcctccgtgcggtccatgccggacaccatctgatccagggtttccgcgtcgttccaccggccccacaccgagcggtagtactcctcagtgatgaactcctccaccggggaggtgcagccgtaggtgcggccgccggccgtgatgccgccccgggcctccacctcttccaccgcgtcctccggcagggccatgtccgggttgaatacctccccgccggtctggaagtgtccggcatcggccaggatgaagtcgctggccgtaaaggcggcgatatacttatccatgtcgaagcccttggcgaaggtgactgtcatggtgagcagcaccaccgccaagcacagggagagcacggtaaccaccgtcttgccccggttccggcccaggttggcccaggccatggagagcagggagacccccttccccgcccgcttcccggccttcctgcgggttttgctcccctcggtgtagcgcaccgcctcaacaggggacaccttcgccgccatccggcccggctttcggcaggacaggagcaccgtcaccagggcgaacagggcggaggccgcaaagaggacggggttgacggacacaacattggtcacgccgttcagccggccgatcaccgccggggtgagacccgcccccaccagccagcccagcagcagccccaccgggatccccgccagggagagggccagtgcctggtagcggatgatgcgcttgagctggcggccggtggtgccgatggtcttgagcaggccgtagaagcggatgtcgttggtgacggagatcttgaacacgttgtagatgatcagatagccggtaaagaggatgagcagcagcacggcggcaatggcggccaccacctggacgtccaatccgctggcgagctgggcgccggtgtagccccagttgacgccggagcggacatagccctccccggcggcgtcctcgctctggaacccgtggccggccagaatctgctccatatcccgctcgatatgggccgagccgctcttgagcatcacgtccaggttccaggcgccggtcatgccgtcctccggggcgttggggttcacccccgcctcgtccagcagggcgtccacccggctctccgggatgagcacgtggttggctacgatggcctcgtcgtactcccaccagccggagagggtgaaggtctgagtggtctcatgcccgtccacatcaaaggtgagggtgaaccgggcccccagctccggctccacgcccagcagctccagcacgtgggtgtcggtggccgcctcgtcggtaccctcctggggcaggcggccctccgccgggtcgcagtacatccagtgggcgtcgttggcgtcggcgtagctcacctccacgtgggctttgttgaaagggtcctgagtcggcatacccacgaaccgccgcaggccggcctgcccgatcagggggtcgtccttcagcgcctcatactgcgcttcggtcaggtatttgaagccgccgtgggagtagccgcccacctgccggaagttgttctgctggaatccgtcgttgatggacagggcgatggtgaacagggaggtaaagagcaccgtggtcagcgcaatagccagcaccgcgatgaggttgcgggtgcggctggcccgcaggctccgccgtgccagggtgcgcacacacttgcggttggagacgttcataccctcgcccccttaccgcgtgacgatgcgcccgtcctcgatgcggacgatgcggtcggccaactgggcgatctcctcgttgtgggtgatcatcaccatggtctgggcgaacttctgcccggtgaccttcatcagtcccagcacatcctggctggtgcgggagtccaggttgccggtgggctcgtcggccaggaggatggcgggcttggcagccagggcccgtgcgatggccacccgctgctgctggccgccggagagctgcccgggcaggctgtccagcttcttctccagccccaggacggcgatcacctccctgacgtagctctcgtccaccgcgccgccgtccagctgaatggggaggacgatgttctcatatacgctgagcaccggcaccagattataggcctggaacacgaagccgatcttccgccgccggaagatggtcagctcctcgtccttcagggtggacagctctcggccgtccaccgtcaccgtgccggaggtgggccggtccaacccgcccagcatgtgcagcagggtggacttgcccgaccccgacgtgccgatgatagccacgaactcgccgttctccacgctcagctccaccccgtccagggctttcaccagggtgtcccccgcgccataatatttcttcagttccctggtctgcaaaatcgccatttggaatctcctcctgtggaaaaaatgggtactgccttctgacagtacccattgtagtggatcaatctttccacactctttctcaaatcttacagtttggaaagatccgccctattcccggggcaggtagagggaaaaggtggttccctggccggggcgggaggccaccttgacatagcccccctgccgccgcaggatctcccggaccaggtagagaccgatgcccaccccctcctccgcccgcacagcgccgccccggtagaagcggccgaagatccgcccctgctcctcctctgggatgccgatgccggtgtcggacacgtccacccggcagaactgccccagggggacggcggagagggtcacccgtccccccgccggggtgtactttaccgcgttgtccaccacattaaagagggcctccgccgtccacttccggtcaaagcgggcggccgccccgcagggctccgccgccagggtaagccccttggcctccgcctgaggacgggcctgggccagcgccccctccagcagcggccccaccggctggggctccggcgcggtggtaatgatccccgtctccagccgggaggctttcaccagggcctggatcagaaaggacagcttctccgcctgccgggacagggtggccgcctgggcggcctgctccggggacagctccccctccgccagcagggaggcgtacagcaggatgttggcgatgggggtcttggtctggtgggagatgtcggagatcagggtctgtatagcggcccgcttcccctccagctcccgggccgaggcggcgctgccgttgagaaaccgggccagccgcccctccagggcggagaggcgggactcgtcaaaccggctctcccgaaagctgccgtccaccgcatcggcgagcatccggtccagccgggccagcagccgccgggtgtagagccactgggccagcccgaagcccacccccagcgccgccagggccagggccccgcacaccgccggggtcaccgtttttcctcccaggtgtagcccaggccgtacaccgtcttgatgggggcgtccgtcagcttgtcccgcagccgtttcaccgccaccgacagggcgttggcgtccacgaactcgcccccgtcccacacccggtccaggagctgctcccgggtcagggtctgcccccggtgctccaccagcaggcgcagcagccgctgctccgtcttggacagctccacctccgtcccgttccgcataaagcgcaggcgctcaaagtcgaaggaaaagggccccagctccagcgcggccgccggggcgctcccccgccgcagcaggcggttcacccgggcccgcagcaccgccagggagaagggcttggtcacgtagtcgtccgcccccagctccaggcccgccacctggtcactctccaggtcgttggcggtgagaatcagcaccggcaccccgctggttcgccgcagcgcagtgagaaaatccagtccatttccgtcgggcaggttgagatccagcagcaccagcgcgtattccccttcgcccagggccgcccagccctgggccagggtggccgccaccctgatttcccggccctccccggccagcgccagggcggtcccccgccccagcgcctgatcatcttctatcagcagaatccgctccatgctccgccctcccctgttttgcgccttttatcatagcacactccgtcccctccggcaaccgccgccttgtccgcatagtgccgcccgttccgccatatcctagcgttgtcccctttgaacaggaggtcaaatataattttaaaaattatatttaaagtttctattgattatattgcgcagcatgtgttatactaaagataaggaaaggtgatccatatgaatcaggaaaacgcactcccccgccgcaaggccatgctctattatccttcccaaccaaagccgcgcccggtcaggctgcgggaaaaggaccgggacccctatgacgggctgcgtccctggtccgccattacccacggcattggggccgccctggccctgctgggcaccgtgctgctcctgctgcgctgcgccgccctctccctcagcccgtggcacgtggtctccttcctcatctacggcgtgagcatggtgggcctgtatacggccagcactctctatcactgccgcaacgtcagcgtcaagggccgtatcgccctgcgcaagtacgaccacgcctctatctacttcctcatcgccggtacctatacccctatctgcctggtggtgctccgcaccgacggtgcctggggctgggccctgttcggtgtcatctgggccttagccctggccgggctggtgctcaccctggcctggatcaccgccccccgctggctcaccgccggcatctatatcttcatgggctggctggctgtggtggccctcgtccccctgctgcgcctgctcccccctgccggctttttctgggtgctgggcggcggcattctctacaccgtgggcggcgtgctctacgccgtcaagtggcctggccgcgataatccccgctttggctgtcacgagatttttcacctgttcatccttatgggctcggtgtttcacttcatgctcatgtaccgggtggtcgcgtttctctgagcacaagtaaaggagcttccgccatacagcggaagctcctttttgcgcggtcattcctctgctggaggctccggcacttcgggcagcgggcccatggtacccacacagcggttgatcggggtccccaggttgtggaacttctcctcgtagtcggtcattacaccgtggatgccgtcggcgtgcaggtcgcgggtgacctcagacaccccaaagcccaccctggggaactggaacagggaccactcgaatagatcccggttgtctgtcttgaagtggatctcccccgcctctgccagcacctgccggtaacgcagcaggaagtccgggtgggtcagccgccgcttggcgtggcggttgctgggccagggatcgcagaagttgatgtagatgcggtctacctcacccggagcaaagaacagcggaagctgcgctacgtccccatccacaaaaaagacgttgtgcagctcctgggcacagacccgctccatggcgatcaccatggcgtccggcacccgttccaccgcaatatagagcgcctgtggattctgcgccgcagtctccgccgtaaagcggcccttgccgcagcccagctccagaaagacctccttcgcctcgggcatcagctcccgccactttcccttccgctcctccgggtcggaaatcagcacccgggtacagcgttccatccgcactcccaggttcggtttttttctcattcgcatagcctagctcacctcgtatgggctatcatatcatatcaaaatgccctcttgcaatccttctgtctatatattataatagaaaagctgactgagcaacaaagtggaacactccaacaaaatatccgggtgtagcgcagttggtagcgcgcttgctttgggaggatagacgccccatccattcccctgaaagcgagaccccggaagtctttgggacagtagtctgcggcggaaattccccgcttgaaaaactcccgcaatcttaggcttgaccacagcgccgcccacagacacgaaaaacttgctttttctttccccacatggtatcatgcagaaaaatcgaatatccgggtgtagttcagttgatagaacgcgcggtttgggtccgcgaggccgagagtttgagtctctccactcggaccaaggtgaatgatcttacctgatttgaacaacaaggtgtctttgtttaggtcaggcaggatcattcatttttgtttagcggcatatcatccacataaaggctccatattctgtatatagtccttggattagttcgccttgtctgtctgtgctgtatggtgatagtgcttcacctaatagtttgcgtatttggcattgaaaactaatgcttcttattttataattatgacatcttagcaaggcaaagagaaacgctgttaggagggcaaagggatgaacaatgcgggaataacaactcagtatggtttcctatttcaacgcaaagcatttattctgtttgctctggaaaatgccggaacgaaacaaacttttactttcgaaggcagagatgacattgaaatatccgcagatgaaagcatatataataagagttacttcgtccggtttctttttgttaaaatggcatgggccctctggagttttcgctccagagggttttgctttgtttactgcggtgtagctcttgaggctctatttcagccccaattcacttcggtcgtgtcaagattttttcgcactttagtttgcaagctctggcatgaatggagtcagccggcaatggaggcatcctcaatggcggcctccaggtgcttcatattcatgtactttttgttgccccactgggagccagctacatggcgtagccgggcacagaccagcataagggcagagttgccgtccgggaagctgcccactacacgagtacggcggcggatctcccggttcagcctctcaatgacattgttggtgcggatacgggtccaatgctcactgggaaaatcacaataggtcagagtctcctcgatgctgtcctccaccttcttagcagcctctttcagcttcatggaacacagctcctccactacggccctggccttttcacgagcggcttttttgctctcctgggcgtggatcgccttgagcattttggctaccagtttcaccttggagcgaggtgtgacagagaacacattacggtaaaagtggacggtgcagcgttggtatttggcttcagggaacacttcgcccacggcctccagcataccaaggcacttatctccaacgatgagtttcacgccgtccaggccacggccacgcagccactggaagaagttgatccaactggccttgtcctctttcatgccctcggcggcacctaaaacctcacgatatccgtcctcattgaccgcgattgccaccaggatggccacattttcaaactctccaccccagttgcggcgcagatagatcccatccacatagacatacggataccgcccgccttgcagaggacggttacgccaatcctcgatgtggacatacgctttcttgttcagctcactgatggtggagggagagaccttactgccccagagagtctcggtaatatcctctacacgccggacggatacgccagccaggtacatctcaatgagagcctcttccacgctactctcccggcggcgataccgctcaatgatggcagtctcaaaggagatccccttgagcttgggcatcttgagtgtgacatccccagaagtggtggtaaggttgcggttgtagtggccgctgcggtagccctggcgttgctcattgcgctcgtaccgggccgcctgggtcagcttctccgcttcggcctccagcagctcgttgagggtttcctctacgcttccgcgcacaagttccttgagctaccccttgataacttcttcgtttagctgtacaatcttttcggacatggtttgctgtctcctttcgaatggtggtgtcgcaacttcattctaccagacatctgcaaaccatgtctctttgtctttttgcgaaacttattctacctgaccttcacttcgaatctcattgtaatatttcctgactgtactccgatccgtccccaccgccttagcaatggcgctcttgctggtaacttccggatgctcccgcatataggcggcgatggctttcttcttctcgctgatcccgtctgggatagcctccaggtttccgctctccttgatggctttgatttccgccttcatctgctcgatcagcccaggcaagagtgcctcacattcctcccgcgttttagcatacacattgcgggagtgcttcttgccatccggccagaccggagaatagcgcccctcccagcagtgttcactgatctggatgatacagccggtgccggcctttcggatcttgccgttgtagggaatgaaggggatgaatgactgcgggtctgtctccggtgctcgctctgaggccacctctttctctttgggatcgacctttgcgatcctctggtcgatctttgccgccgcctcagaccgcatgggattggtgatgtgggtgtagatgtccagtgtagtggccgccgacacatggcccagcatcgaggagagggtcttcacatccatcccgctgcccagtgccatggttgcaaaggtatgtcgcaaatcatggaacctaatttgcttgcactgggcgtgttccaggatgaggtgtagccgtgttctgatgtaggctgggtccagtggcgagtcctccttgagcggcgaagggaacatccaccgggaatttatgccctccctgtactctttcaggatggccagaagcggttggggcaggctgactgtgcggatggaggacttcgtcttgggctgagagatcaggagtccgtcctcctttgtccgatagacctgcttggtgatcttcagttccccggtttccaggtttaggtcatcccactggagggccagtagttcgccccgccgcaggccggtggtcagttccagcaggaacagttcaaagtatccctccgccttggcttgaatcaaaaaccgctggatctcctcacgggtcagcacctgcatttcgcgggcttttttgggcggcagtttacagccgacggcgggattcacacggatcaggccctcctgcactgccttctccagcgcggaccggcagttggcgtggcatccacggaccatagtgtcagacaggctttcgctgtagtgctccgcatggaggagccgcccgttctttttcagtcgggcgtagaactgctgcaggtcgttctgtgtcagttgattcagagggatgtcacccagttccgggatgatatgcaggtagatcctgttttcatatcctgcacgggtggtagcccggagtttcggcttggagtagttctgataccagaagtctatccaatctccgaagggcatttcgggcttgattttgtccgacttgggtggagcgtactgttcttgtaactgcttcagtttctctatacattcgccttttgtcttggccaggacattcttggttttggggaggcccttttcatcgtagccgatgaccacccggccctcccaacgaccatccttgcgaagtcttacagttccttcgccgttctttcgttttcttgccacggtttccactcctctcccaacaggtctgtcataaagtcacatacggtattcgccgcctgtttctgcatatccccggtcacatgggtgtaggtgtccagggtgaagctggcgttggtgtggcccaagatacccgagagggtcttggcatccacacctccagcgagggcgtgggtggcgaaggtatgccttaaatcatggaacctgatacttggtagaccggtatttttcaggaccgttttcatccgattgtaggcataaccgggattgaccggctcctccgggtgtaggggattggggaatatccaatcactgatggcggttttcttccgctcgcgcagacgctgggctgtactgtccggcagggatatagtgcgtctgcccttgttggttttggtttctccgacctccaggctgcctgccttgcgggtgctgacggagcggttgactttgagggttccctccgcctcgtcgaagtcctcccatcgaaggccgcagatctcgccccggcgcaagccagtggtcagttcggtgaagaagaagtcccgccacacttcatcctgctcgattgcggccatgaaagtgtccaactgttcctcgttcaggatctgctttggacggtaattgggcttggggaccactgtgccttcggtgggattcttggcgatcaggtgtgcgcccaccgcgtctttcatagcgtggtggagcatggcgtggatacgggagagcatggcgtctgagagttgatacccgtattccggatgctcatgaatgcgaccctcccgtttcagttttgtgtacatccgctggatgtccgtcgaggtgatgcgggagatcaccttgtctcccaggatgggcttgatgtaaagtctggcatactgccggtagccgtacatggtgctggggcggatcgttcctgttttgtattcatccagccagcggtccagccactctcccaatgttatgcggctgtcctcggtcagctctacatcctgataggtttcgatgctctggtggagtttgctcagcaactccttctgcgtgcggccgtagacatagcgaaagatgggttcgccgctttgcttgtggcccactacaatcctgccctcccaacggccgtcttccttcttccgaaccatgccgtcgccagatggcctgcgctttgccacgatgatacacctcctgttcagcaacacaacataccgcagaaagagagacctatccaggggcacagcgaactgttatcaaaaagttatcatttggggtagcgaacacagtggcgatcaatcaaaaatttttctgtgataaaccaaaatatatggtatactgtcttcataaagtatcggaggtggccgcatggatctatacgatcaggtgaaaaaacagtggcaaatatgggctgtccgttcaggcgaagacttggacctgcgcctggacaacttccgcatcctcttcgcgtacaactccgggaagatcgaaaacgcagcgatttcttaccacgacacccgggagatttttgagaacggccgggtggtcggctataccggcgatccccgcacgctgtttgaacttcaaaatcagaaggtctgctatgacttcctccgggagaagattcctgtcaaggagccgctttccatcccactgatcctggagatccatcgcgcgctgacggaggggacttacgatgagcgccgttatctggtcaatggagagaggcccgggacattcaaaaaacaggactatgtgactggcatccatgaggtcggctcctacccggaagaagtggaaggtgacttgacagaactgatcggtgaagtcaactctgtaggtccgaaagccccgctgaaggccggaacgtatctccatgcgcgttttgagaatattcaccccttcgccgacgggaacggccgcgttgggcggacattattgaactactggctgatgatcaacgactatccccccatgatcatttatgaggaagataaaaaggcatactatgacgcgctccagcagtatgatgaacaggaatctctggatgctttggtccgtttcttggaagcacagacggtcaagacttgggcgcgcgtcatgaaactctccccaaatgatacgccgaaacatcaaggaatcgaatttcatatgctgtaaatgcctggcctcccgtagcagcgggaggcttttctctttgttttgcggcgcaatttttgaaggggtaatagttcgaatattcactttttggatttgcgctaaaaccgaccgatatccccgaagtgaaccccgcgggttcacccttacaaccctgatttcatacgggtttgagggtgcaaccctctgattccggtcacctgtgacccccaaagtgagccaaaccgaccacctatgacccccgcaggcaaaaccccgcaaaccgctgtcccgccccgcgttgcagggcggtgtggcccggctggggggtgcttgcgacccccagcctttatcctgcactattttcgacccctcggtccaccctttggtggggtgaaaacctcttactccttcaccctttcaattcccgccacacagccccaacacggcgttgaaatccagctgtggacacggatgctcccccgccagttaaaggcccgcacagcggctcacaggcggtcaagcggggctttcctgctctgtcaggagtttcgccacccgctgccgctccgcggccaactccatttcctccatctggcgggcatagtactcatccatcacctcctggatggggcggagagtaaagcgtagattcccgttgcgtttttctcctgccttgatggtaacctcagtcggctcggtggtgatgataccacgctcctccagttgccggatgtatttgcgtaccgtgttctcactcatatttactgccttcccgatggttttgatgctgggccagcactggcgtgttttgcgcccctcacaccgcctcaggaaactgtacacagccaactcaccagcggtcagcccccagagaaaaatctcattgggcaaagcaaaaaaattcccatgactgcagaatctcatttccaacctcctgtgtgctcattcacccattggatgaactgttctttgggtactaccatcctgttgccgatgcgcagcaccgggaagcccggttcgtgcatcagctcgtagcctgacgatggtgatacgcccaacacctttgccaccgttgccgagttgaggaacaacggcaggtcgtcgtagcttttgtagacagattctttcatgctggcctcctccttcaaaaaattcctctcaatttatcattgcagaagacggaatcgtttgataaccacaggaaataaaattcggatgtatactcaaaccaagatgttctgatttggcggttttgccgacagttactgcttgtttctattccgaggagacttgctgtgcaacataggtttgacatactttcggttgccgtctaattttccccttcactatgtattgggaaaaacatatccttttgacatattcttgacagaaaggaggcgcgcctgctgacaaagcaggcgcgcctcttgaagccgtgtcgattcagtttttcactgtttgtctcagacggcatttgccctccgcttcgtcccgctccttcagcagccgggcgagggcggagaggaacttcttctgcaggtaatccacactgccccggttgagtcggtgggcctcggcgtacttgcgaatggacaggccatccacaaaccgtttccgaaagtaatcccggtagtccgccagaacggtctttagggcattgtccagaaaacacaaatcttctttcaatttgccgaaatcgcttttggtaatggcagcataccgcttttggtttacacagaagcgatacttgcgcaaatcgaagctgtagttctcgcagagctccctggcgtatgcgtggtaggtggcggcctgctgatacgcccgggcgtcgtattcttcctccatctgccggggccggattttgcgcaccggcccccggaagccctcatcctccagccgctcgatggcggcctctgaaatcttcatgttggtcagccgcttgtacttggcccgcctctccccgctcacctccacaaaagcgcaaaaggactttttgctggaggtgtagtatctggggacatccgcgaaagggtaggtgatccagatgaccacttcctctccgttatcggagtccgtggccagagaaacgacatagacaaccttgccgtcatagcgccggtagtatcccgcacagatccgtatgcccgccaatgaatcatcctcccttttttgtttaccgcagggcaatttttgatgctgcatcccgctcctacggcgcgaagcggtagccgattccccagacggtctggatatattccttgccggaggaagccagttttctccgcagaaacttgatgtgagagcgcacagcctcatccacattaaaatcgctgtcacatctccagatacgggtatagagctgttcccgtgtaaatacctgtccggggtggctggccagaaagtgcagcatattgaattccttccgggttagtttcagcagggagcctttcgagagtacttggcgatggagtgggtcgatgatcaggtcagttccgaaggtcagagtataatattgcttctctggatgctccgactccatatagaggcggatgagcgcattggactgggcaacacagcggtgcaggtcaattggcttctgcgcacagaccgttgccccagatgaaagaatggcaacttcgtcttccagcgatagcgtattggtgagcaccagaatcgggaccgccttggcctggcgcatggtccgaagcagttcccgtccatccatatcttccagcgccgggtccatgatgaccaagcaataccgatgccgcatgaagctgtccaatgcctccgctgtgtcaataaaataccggacctctgtggtatcgtcctgcagggcgtcccggagctgacggcaaaggggtaggtcatcatcaatcagcaggatctgtttccgcatcaaaccgcctctcgttctcggttggctctgtatttgggtgggccttctgatatagctcagccagcttctgaaaactggctgggctgatcacatgctccatgcggcaggcatcccgttcggctgttttcggatcgacacctgcccccatcaaaaggcgggtaaagaagcagtgtttctcataggtctgctcggccacctcgcggcccacatcggtcaggtggaggaagaagtccccatccatggtgaggaagccgcccgccttcaaggtagctaccgcgtgacacacgcttggtttagatacccccatgtgccgggccacatctacggagcgtaccatgcctttttccttttggagtaccaatatggcctccagatagtcctcgcccgacgcatggagtttcattgggatacctcccttatttcagatggatcgccgcaacatccacatggtttggaatactgttgaaagtataagattcaattacttcgttgttaaatacggcatattcgtttctgtagttgagcggaatcaccacactgctctcattggcggagtccagcgccgtagtatagatctcctgaacgactacgggatcatctgtgttgtaaagcccgccaatcaatttcttggcgtcctcgtcgctcatgatagccagggcctttgcgacctgcggatcggtggagtagataccgctgggatcagtatagtcggtagacggatacatatttgccacgaaggtgtatggatcataagggaaccagtagctcatgtaggcggtcatctcgtagttgtcctccatgaatacctgctgcatgaaggccatcaggtcgatgggattggtcttgatctcaattcccagttcagccatagagctctggaaaaagagtaccatgttgtcataaacgcccgtagaggggtaggtgattgtaaaggaaagcgccgttccgtccttctcccggatgccgtctccattggaatcgacccagccggagtcttccagcaaggcaattgccccatccatgtcgtagtccggggtgggcaccgtagcggtgcagtagggcatatccgctggcatcactgagtccgcctttgcgcgcagaccggagtaaatattctgcgcgatagattccttgtcaatcgccatctgaatggctgtgcggacattcagatcatccagcggcgccacctcatcgttcaacgcgataaattccgtcacaaagtcaaagtcagagatcacgccggtgatcccctccacctgagacagctccagataggaattggcgtccagcgtatcagatcccatgataaagtcaacctcactggcccgcatagcagcaaccttggactccgggatcacctttacggtaaagcggtccacatccggctcttcaccccaatagttcgggtttttcacaaaggtgtattccgttgcggtttcattcacgctctcaaacatatatgggccggtgcctggggtgtgagtcatcaggtattcggtattcagagagccgtcctcattgaaggccgccgcagaaaggataccgcggggcatcaccatggaaagatcgttcagaacattgtaatagggacggctcagatggaaagagacggtgtactcgtcatccacggtgatttctgttgtcagcatatcaagctgaccataattggcgctggtgccaatgaccgacttcatattgtcaaaatagagtttgactgcctcggcattgaacgcaatgccgtcattaaactgcacatcgtcccgcagatggaaagtataggtgaggccgtcgtccgaggcaacccagtctgtcgccaggcatggcaggtattcaccgtctcggtattcgaccaggccctcatagaaattgttcatgtaatatgtggcctcataggactgcacgccaggggcaaatcccatagaaaaattggcgctttgtgcaatggtgatggaccgttcctcctcgccggcaggcggtgtcgaggaagatgcggaacccgggtcgtttgcagtgtttccacagccggcaagaagcatggcgctcataacgccggtcagcagaagggacaagaattttttcatgctgttattctccttttttgatttattgcaaggctctccgcttggagcggactgcctctacaagctcttgtgaatagggctcctgaaaatcagagaagctcctggggtgctcaagcgtttcgatgattttgcccctgcgcatgacatgaatcgtgccagccatatacatggcggtgtccaggtcgtgtgtaatcaccagaaagctgatctggagttctgtttgaagctccttcagaaaatccagcacctgttttttcagtgtgacatccaatccgctgaaggactcgtcaaagataatgtgttggggctgggcagccagagcacgggcaatacacagccgtttttgctgtccaccggagagttcatccggccgacggcggagtgtgtcccgctccagccgggccatgtccagcagttcaaggcaccgctgttttcgctcctccgtccccatatggaacagcagccgcaggggctcctccagaatggaagccacgctctggtgggggtctaaagaccccaaagcgttctgcatcacaagctggaccttgccccttacagtgtggaactcctttctcccgcaggcggacacctccagaccatccagaaacacccgtcctccgtccggccgttccacataggacagcactctggctaaagtgctcttgccgctcccgctttctcctacgatggcggtcactcctccattcccaagctctatggagacatccgaaaccgcatcgaatacggtatgcctgccgcccggaatctgatattgttttgtgatatgttccgctttcagcatagttcctcctgaaaaagtacgcttgcctgtacaagctgcctggtatattcgtgctgtggagcagaaaatacctcccgcgtttttccttcctcgatgatctctccgtctttcataacggctacacggtcgcacagtcttgccgccacaccaaagtcatgggtcaccacaatcatggagacgccggcccgcctcagtttctccaattcattcagaatgagatattcgctggccgcatcaacagcggtggtaatttcgtctgcgataatcaattccgggcgctgcaggatcgtcagagcaatcatcacacgctgcagcgtaccgccggacaattcatggggatagctgttgatgattttttcggcatctggcaagttgacatccgcaagcgcggcagccaactgtccccggaactgcgtccgttccctgcatcctttcagcgaaaagcccagttccatctgtttccccagcttgagcatgggcgcaaaggcggtcatggggttttgcgggatcatactgatctgcttgccccgatagccgtccagctcattcagcttcaccgcaagcatttctttcccgttccattgcacacttccgcgcaggtcaaaaagccgtggattcaacagccgcataatacacttgctggtcatgctctttccgctgccgctctctccgatcaggccaagggcctctccgctttttacggagaagctgacggagcgcacaagggtttcctttgtctgctttgtacggatggatagattggtaactgtcagcatggctatccctccctcggtgcgcagatgtcccgcagggcctccccgaacaggttgaaccctgctgcggcaaacagaatgcagagccccggatacaccaggaactgcggatggctgaacatcagtttattggcatttacaaacatggcgccccattccgccgtccctgtttccagccctaagccgagaaaggcataactggagatcataatgatgatggaggacagccctgtgctgtacaaaaccagaaggtgcggcagaatattggggatgatatgccggaacacaatgcgcagctccgaacagccggacatccggcaggtgatcacatagggctgattccgctcccgaagcacatgggtgcggaccaccctcgcgttccagacccacatggcgattacaatagacaggacgatgctggccgcttttgactcaaagagccccaccagggtgatggcaacgaggaacgggggaaaggccataaaaatattggagaccacttcaaatatgcggtccagcaccccgccgatgtaggcgcacagggtagccaccacggtgctgataaccgccagcaacagcagtgtgggcagcgcgatactcagagaagccctggctccgtagatcaggcgggagaggatgcagcgtccaagctcgtccgttccgagggggtactgtgcgtccggcggggcgaagctgtgggccacattcagctgcatcgggtcattgggcgcaaagaccggggccagcagcatcacaagaaacacgagaagcatcatggcaagaccgaggacggcctgcgggcggtgcatgattttgcggatcataggccgcctcccttctggctctgcgggtttagaagcgcgttcacgcagtccgcgataaaattgaccaggacgaaaatgacggcggtgagcagtacacacgcattgatagtaatggtgtctctggctcccaatgcagtgaccagcatggaccccagccccgggatggagaacacgctttccaccatggcgctgcccgcaatcataaagccgaagctctgcgccagcatggtgatcagcggcggcagggcaaaccggctcaccagattggcgattttccactccgatacgcctcgggccctggcatacaggacaaaatcgctgttatacccatccaggagcgaggaccgaaacacacggatgttgccggcggccataggaatagccagcgccagggccggaaggatgaaatccttcaggctatccgctcccataatgctgaaaacggggatataaaccgcgaaggcgagcaggagcatgaagccgatccaataattcggcagagacatacagatgatgccgaacaggtagatgctccgatccgccaagccgccttttctgctggcggacaacacccccagcggaatactcagcaaagtggcaaacaggagcgccatggcagccataaccagggtgggccggatggaagccgacagttcttccacaatcggccgcccggtgttataggagtttccgaaatccccatgcagggcgttccaaagccaggagccgtactgctggagaatcggctgatcgagcccaagttctccccgcaccagttcaacctgctgcggggtgggacggttgtaacggcgcactgccagcgcctcggccgcatctaccggggacaggttggtgtaaaagaaggtcaggatggtgacgccgaacaggacaatcaccagcaggccaatccgggccaatagtttcttgctcatacctccgctttaacctcgttacttttccgctccgcaatacgccacgattctgcggatctccgggagcagacaaaatccgcatagatacctccctgctgcatcagttccgcatggcggccccgctgcacaatccgcccttgatccagtaccagaatctgatccgcctcctggacagttttcatccggtgtgcgatcataaccagagttttcccggcggtcagggccttgactgcctcctgcagctccgcctcgttctcggggtccacattggctgtggcctcgtccaaaatgatgatcggcgcgtccttgagcatggcccgggcgatggagagccgctggcgttccccgccggagatcgtggcgccgctctcaccgatgatggtatcgtagccgtccggcagggccgtgataaagtcatggcaccgggccgcctttgccgcggccaccacctcctcatgggtggcgtccggcttgccgaacttgatgttgttctcaatgctgtcgttgaacaggtacacgcgctgaaagaccatgctgaaattgtgcatcaaactatccagcgcatagtccttcacatcaatgccgcccagcttgaccgcaccgctgtccacatcccaaaaccttgccataagactggtgagggtggtcttgccggagccggagggccccacgatggcagtggttgtcccttccggtatggtaaagctgacatcgcggatgatttttcgctctccataggagaagtccacatgctcgaaggaaatatcgcagtgcttcggcgtctgtaccgagccgccctcgtccatccggggagcgcggtcgatttcctccacccggtcgatggaggcgtcgatcatgggcagcatgaagaacatctcgccggcagactccagctcgctatataccaggaaagcggaaaccaccaccatcaggcaggtaaagagggtcatactgccttgcaggaaaaaccagattgagagcagaatcgccgccaccgccgtgacacgcaggacgatctgctccaacacattgtagggaatacgcttgcgctccagcttgaaattctgctgttccgtctcctcaatcgtgcggttcagcgtctgattggccgctttgtctccatggaaagcgcgcaccacgctcatgccctgtatgtattccagcacagcgtccaccagccttgtctgggccgccagccgccccggagacaactctctggatttcttcagcaaaagtgagttgacccagaggaacagaagcataccaagcaggaataccagcccaatgcgccagtcaaagcacaggatcgccaacgagaagatggtggtccgaatcatgcccaccaccgtccgggcgatcaccgcaaaggacatgctctccaggtcctccatggtggaggtggccgccgcggtgaggctgcccaggctctgggcgttgaagtagcccatgggcatatacttcatgcgctccccgatatggatgcgcttttccgcgcacatccggtaattggcgtggccctcgctgttgtgggccagataccagcacagggcggctccggccacgctgaccgccatgatcccaaaggccatccatggggtggccccggtcatgttctgctctaccagggcgcgaagcacgaccagcagcgccacaaactgcaaagcctcaaaaatgctccgcagcagttcaaaggccattcccttataccaggtacctttctgctccccggcaaagcggaaaaaccgtttatatgcgtcaaacatgcttgccacctccttctctcatgtccgcatctttcgcctgcgtgtgggccgcccacatctgcgcgtagaggggacaccgcttcaacagttcgtcatgtgttcccgcgtccaggattttcccccgctccactacggcgatttggtctgcatcggtgatggtgctcaggcggtgggcgatgacgatgagcgtctttccacgggtcagcctgccgatggcgtcctgaagcaccgcctcgttctcgggatccgtgtaggaagtcgcctcatccaaaatcacaatcggggcgtttttcatcatggcccgcgcaatggcgacccgctggcgctccccgccggagaggtgtccgcctgcgccgcccaccacagtgtcatatccatgatccagacccatgatgaaatcatgacagccggacgcctttgtcacggcctccacttcatcgtcggtggcctccggccgtcccatacggatgttttcccggacagagacattgaacaggaaattatcctgagagacatagccgatgagatccattacctgttccggcgggaggtttttcacatccaccccgccgatggcgatgctcccgccgccagcgtcccaataggaggcgatgagcttggcgatggtggacttgccggagccggacggccccaccagcgcggtggtcgtgccttgccggatattcagcgtgacgccgttcaaaacctgcttatccttgtaagcgaatgtcacatcccgcaggtcaatatccagcccatgcagttcttttctctgcgcaggccgctccagatccggctcggacagcacagcgccaatttccccggtgatggtcgcaattttggagaaatcatcggtcaaaaagatcgccgctaccaatggccccacgataccgagggacaggattgcaatcgtgataaaatccggggcggtcagactgccattcctataaaagacacacccaatgggcagaacgccgatcagcacagcgggccaaatggtcatcatcagggcggagtagccctgcgtggatttcatccagtccagcatgaggtccgcgctctgccgcacggcctgcgtgaacttgccataggatgctgcactctggttgaacgcttttatgacctcaatgccgttgatgtactccaccgtggtggcgctcatgtgcttgccagcctggaccacagcaccatactttttcgggtactctttcatctgggccatgtaacaaaacatcccgatggggatggtgataagcgataccaacgccatgcgccagtccaagagaaagaggtagaccacaatagcgacaggaaccagcagattagaggtcatttccggaatgatgtgggccagcgggacctccatctgttccacacgctccaccatggttgttttcaggcggcccgatggcgtatcagtcagatagcccatggaaacgcgggtcagtttatccgccacagcccgccgcagttccgacagcacatggaaagtggcctcatgggagcaccgagtggaaatgccgtgaagaatggatttgagcagataggcgatcagggctgccgctccccacattagatagactgagaaagacttttcgccagaaatgagcaggttgaccattcttgccacagcaaagtatggtatcatcccgctggtcacgctgagaacagcaagaacagtggaggtaataaaacccgctcggtgcggtctgataaatgccatcaaactaaatggcttcctttgtttctgcatcgtatccctcctacaagttagcggtttctaaccatccaacaaagaaaaaggccgacaacccacaggattatcctgcaaatcatcggctctgcgtctttgcgtctggctctgacaatatgatgttttgtccctgtacatcaacgatgtgttcctttccgcatttgggacagaaaagcggaaaacgctttagaacggtgtctggattcactttggtgcgggtcttgttgccgcaggtagggcagtgaatccagccgtttcggtcaatccacccgctcaatggttttcacctccatctccgaagaagatggttttccagccggcggtgtaaaaacgccgcatcctctggatatgctcgaccgcctgatcctttggcatatcgtggatgaccacctcgaacatcccggtataaaaggcgctggacagcagatggcccagctccggtgtaaggcggccgctggaaattgcgtcgttcccggacgcctgaatatagcgcatggtacattggttgtccagttccacgatccggtggaggaattcctgatatgtactgttctccccactggttaaaagcagcttgaactcatcaaaatgatcgtagatatagtccacagaggcccaaaaaccgtggtcggagaaagaacacatttgactggtctgttcggatccgggtaactggttaaactgctccagcgccgattgtattaagccacaaaaatcatccatggcaggctgtacaagggaacggtacaggctctctttgtccgggtagcgaatataaatcgcccctttgctggagccggccttttccgcaatcacacggagagacgcattctcgtacccattcctcatgaattcctctttcgcgcactccaacaatttttctgttaccccggcaattcttttcgccatatgccacctctgttctatcaagtccaccagtttgaaaccactggatttaatatagcacacaacgaaaatcctgtcaatatggcgtatcgcgtatttttgtttacagccctgcaaatcctgagccgtcagaatgaagtacttcgcctgcttcatggtgttcttgatcctatcactggatgccctgacccaaaagccctccttggtgtgttgaagtaatgcccgccaactcattttgcgagatttttgaccacagcttcagccacagtgtggtgtggagtatacggaaacagcacattcaaagagtggcagaaagcaatcggaacggagcgaaaagagccaaaattgagaggaaataattcaaaaaatctttctgtacctatttgggagcaagatgccgggagttcgagtctccccactcggaccaaacaatgataatccgaactacattatccaggtgggtaatgtgttcggatttatcatttctattgagaatatattgtaaaacaacagggggaggaaacttcgtttcctccccctgttattagagacgcatctggagtcagtggatcgtgccaggtggatagggcccataaatggaggtcaagaatccatcctcgtctaaggttacctccaggaaggaatcatccgccatcgtcagtttgaccactccctcatactgcgccgggccgatggacgcaacctcgccgtagtcgaagtaactgcttttccgataccaccatagggcgcgctgctcctccgtcatgtccgcccattcgccggggaggttcaccgcatccttccgcatgggcgaccagggagcccactctgactgccactgcaggtttatgttggggataaaactgctgtaatccacaagcacccaccgactgttgtagttgggcagatcgtagctcatgtagaaaaagctccgatgatctccgtcccggtcgatggcgacctgctgggattctattccgccccaaagatagcagcgctccgggcggtatcccgacaacgcctccagttcctccagcagaagggccccctgctcccgcggagtgggcatcggcgtcccatccggcgtccaaccgatcagctcgtcagggcgcagttccataaaggtcacggtagtgccgccgatggccccgccctgtgtgcgggtgtcctggactccatccctccgccagagaaagccaggtgaaaggcggtcgtacaccggggcgtattcgtccagataccacttggtgccgaactcataggaaaaaccaaaagctctgtccggctcataaaacaggaagaaatagccctccggcaccgacagctcgtctatttcctccggcagggtatatatacagtatccgtcgggcaggcggtcatagatctgataggacttgcggggggcctcgccctgcggcctggcgacgatttccagctccccgtccaaatccaggtcggccatgccctctaaatgttccgtgatatgaaagactatcctgggttcctggtcgatgacagagaaaaacaccgcatgctcgtcaccatcacagcgcactacaaagctgggatagcccagaacatttccgacgaaggtggcccaagagtcgtcctggttccatacaagcccctcctcgttgcagcgaaacaacacgttccaatcccgcccgccgccccgtccaaggaaccagcaggtggggccatcgtagggttcctcagtccgaaccagggcaagggtgcagttcccctccatttgcagctccgaatccacctcccagccctcggggaggtattcctccggggagccccagggccgcaggcggtcgaggtcaaagtcggccagctcggagcactctaattccaaatggtcaggccattgatggtattccagctgccgggcaaggcgttcttcctcaccaggagatgacaggggcatatcgaacagcaccgttccatcctcttgagtaggaacggttactgccgcatctatcgctccctgcggagactggaaattcatggtgacctgtccgtttccaggtgacagttctcccccatgagaggcagacgactgttgcgagacaaaccagcccagagagaaagccatcacaagtacggccactcctacaacgctcgtcagtaaaatgcactttttcgatattttgggagaagaaggttcccgctcctcctctttgagcaattcagccagcgtaccggcgggaagatcaagcgccgcttcgatgccttccaagtttcgcggggtggggacagattgttctatctcccatttggacaccgcctgcctgctgacaccaagttcttctgccaatcgctcctggctcatgcctttttcttctctggcttgacggatcgcagttcccagcatagacaccactcccttcttgtctcgccttaattatagcaagtgggaccggttgcgtctacaaactttcccgcaactggtacagttgcgggaaaaaaggcgggagcatcgtttgagatgcccccgccttgtgcgttagtcttgttttaccttgttctgttcctgttgcgctttccactcggcaaattcccgctgtccttcctcgctctcgaaaaaggcctgtatttccgggagcaggacacgggccagggcctccacttcatggtagggtatcccggtgccgtagtcgttgaccttcttcttcctcgccataggaaccgccccccagtcttatagctgctcctcgttgaacaggtagccctggaacacagtcccatccccggtgatgaaacggccccttgcgtcttttggtatctgctcggcggcgctggtgttgtcgagaatgatttgagaaagcacactatccgctctgccgcaaacacggaaatccatgttgttgcgtatctggccggggatgatggtcgcatccggcctctgcgtggcaagaatgagatgaataccaaatgcccgtccctgccgcgcaatggtggacagcttgttttcaatttgtgccagcagcttcttccgttcgttatcagctccggtcttgtccaacatctccgccacctcgtcacaggcgaacaccagccggggaagtccctcccccgtggcctcgttgtaggtgtccaggtctttgcactccgtttcttccagccgctttttgcggcactccaaaaccgccgtgagttggtctaaggtatagagcaattcatcctcccggaaacacatgtggcatttctgccgccaaaccctggggaagtctacgccgcccttgaagtccgctatgtagacctccgcccccttttccaccgcctgcataagcagcagcttcagcagtacgctctttccgctgcccgtggagccgcccagcaggatatgggggatgttggcgaggttcaccgtcacaggccccgtcaggctttcccccagcaccaacacaaagctgtccggggacagatatttgtctttccaggggagcaaggccggaaaatcgctctcggcggggacggcatagacacagatgattttccgcccctccgcccatgtcattttcgctatggtgatattcagggccgtttcaatcctggcccgcttgtcctcccactcccccagaggtatgccacaggggtcaaactcccagagcgtcagccggggcgtgtccttgtcccgctgcttgcacaggaggataggggcctctccggcgtggttgacaaggcccaccttctgcaagccctcctttgcctccctgccgccccagggtgttcccaggagtaccaggacggccaggaggccgcccacggcgtagagaggcactaacaggtctataacggcgttcaggacgggggaaaacataccgtaggcgtccaggccgaacaggtgtccccggaacagccagaccagcacagcgcccgcaaggtacgccgtgagcagcagccccttgtggggtgtgtccctggccgccataagccccgctttcatgcgccgaagcagatggcggttttccgtccgcctggtgatggtgtctttatcgtttctggtcacagggccagccccctttcttcttctggacggtggttccgtccggtaaaaactcaatgatgttatggatacggcggaggaacgcccgccaggtttccggcctgtcccactgttcgccccggtactgcttttccagcggaaggttagaggtgatatagaccgtggtataacaggccgttttgtcattgtaccgggcggggagggacagggggtaaatgtccagatagttcagcatatcttcaatggggacttgcccgctgaactcctcgaacacaagcacctcctgcccgtggtagccgtcaaaggaaatgccttttgccgcccggtagtttgtcacccggtaaatgctccgggggtcgtgggcctcgtaaatgctccttgtcttgcccgccccgctggccccgtagaggtaggatacttccaggggcctgttttccacggcgtacttctccgccgtcaaagtctgccggagcaggtcaatgtcacggacacgaaaggccatagccgggttatcgtcaatgatttccgtggtggtcatgccgtcccggatattctggacgagccggaacatctccgggtgtttctccgctcgctccggcggggcctcgccccattcctcgaaagtcccaggcaccgaggtttccgccttgtccgtatccgcccatcggccctccttgcggatgtatgcccggttttcctgtaccgttccatatgccttttcgatatgggccacgggaaaacggtttttgatggtggcaaagcgcacaggcgatggagcatagaaaaacaggtgcgtgtgatatgtccccgttgacgctgtttcatcggccatgcagtaataggccggggaaaaccgctgtaagatttccttgattgcgctatggtctaacccggcctctgatggattgttaatcaccagcgcccattttcgggattggctgttgctgcccatgtaaagcctcccttgtattgctacatgctacaagtttcccataaggggtaatactgcccccttatgggaaaggcggcgctggcgctgccgccgggggacacttcccttgaggggaattgtcttttccccggctggcctccccagcgccgccagcgcatcaggtcttagggttcaccaaatggatacccgtggccctggcccccacctggggctgcccctggctccaatagatgaatacctccaggccgtcaaagcgcacctccgcatagccgtccggggcgtccatgcgtttatccccgtcaatccgcacattgattttgtccaggcccttttccggcatagcgacggtatagcggtagccgaggacggaatcagttttgcggttttcacgatactcataggccggggacacctccaccagccacagtttgctcccaaggctccgggggtcaatgataaggtcggtgatcttcataggttctcctttccgggcggtgcgtggcctttgccccacccttttgaaatcacaagtccttgtgttgtccccatcataccagggaaaaagcgaaatgtcgtttcatgcgtgaaacacttgaaagggcgcaaaaaaccgacgcccctgtgctgtatagggcgtcggcttttaatcggtcattcacttgtcagatgtcagaagggggaggcccctgccgtgcagcaggtcgttggtttcgtctacggtgtagccatgctccgccgcctcgtcccacacatagaactccgggaacgctgtataaaacagctcccgccgctgctctaatgtgagttccagcgcctgggcaatggcctgtatcgtccttaactccggccggtagtaggggttcctttctgtgtcgtaactcgttattctgctgatggtcgctttggactgcccggacattttcgccagccgtgcgggactccattccagcacggctaaatatccgttcaccagcttggacaattcaagtctataatccgggccttgctttggcgtctgaactgccaaagctgtatcctcggattacagatttcggtttagatgggtttgccgccggaggtggtgcgcctggggtcgtgtcgctggggtctatggtatcgccgtaacaggaaaagactacttaccatagcggccacctccttatcgtgaaatacgccttgggtgaataatagtgtttactatccacctccggcgcgcaaagcccgctcacgataattcaatgttacattggaatacggaaatggagccgtattcccccgtcaatcctggggcacttgccgggacagcgtacagcaaccgctttcccatacccgtcacatgtgggcggtatcttaaataccgtccggggttcctccttgtgtgccgctgaaaacggcggcttactttgcttcttggtttttcatgtttcatttatggcagggcaatgatatattaccatacctattccatatattgatgaatattttgtaaataattctatatcttgcgttgccctgcctttcttgccagtagcccagccccctccccctgtcaatggtcaagataaacggcccatgtgccgccattgacagggggaggggcctgggcttttcggttatcaaggggtgtcagccgcaggctggctgacaccccggttcaatactgggatttacgaggaaacaaaataaggagttgactaatatgcttatttgcgatagtcttatatcaacagaaaaaggaggcccgcagaatgaaagaaatgattggtgaacgcctaaaagccctccgtgtgggtgtccgtctgtcccagacgaaacttgccgggatactcggcacacagcagtccagtatcaaccgatacgagcagggccaagccgtcccagggccggagatgtttgtgaagtacgctgactattttgatgtgtctatggattatctctactgccgtacagacgagccacggggcaagctgtacgactacaagccccaggcgcttaaagaaaagatggaacagagcgaggaaatgcgggaatttatagaaatgtgctttgacccgcaagcgcccgtcaacaagcgtctgaaagaggcgctgcttcggattatgacagaggaggcgaacgaggaatgaaagcggtgatctatgcccggtattccagcgacaaccagcgggaggaaagcattgagggccagcttcgggagtgtacggcctattgtgtgaaaaacgacattaccattttgcggacatacattgaccgggccttgtccgccaagaccgacaaccgcccggacttccagcgcatggtgaaggacagcgccaagggcctgtttgatgtggtcattgtctggaagttagaccgtttcgcccggaaccgctacgacagcgcccattataaggcccagcttcggaagtatggcgtcaaggtgctttctgctacggaaaacatttccgaggggccggagggtatcattctggaaagtatgctggaaggtatggcggaatactactccgctgagctgtccgagaaggttatccggggccatacggaaaacgctctgaaatgcaagtataacggcggtacgcccaccttcggctatgttatagacaaggatatgcagtaccagcttgaccctcgcaccgcccccgtggtgctggaaatattcacccggtatgaccagggagccaccatgaaggaaatcatggaggaaatgcggcaaaagggcgttacaacggtacgaggtaaaaagattgacctgaactttatggcccgtctgctgaaaaaccggaagtatatcggggaatacagctatcgggaaattgtcacccccggcggtatccccgccattgtcccccaagacctgtttgacagggtgcaaaaacggcttgcggcaaacagaaaagccccggcccgccacaaggccgaggacgattatctgctgaccacaaagctgttttgtggcacctgcggggccatgatggttggcgagagcggcaccagcgccagcaagggccggaaataccattattatcgctgtgtaaacaccaagaaacaaaaaagctgcaacgccaagcacaagagcatacggaaaacgcccattgaaaacgctgttgtcaacgctgttatggcaaaggtaatggacgataattttgtggagtacatagccgacaccgtgatggacattcagaccagagagagcagcgtcctcccggcactccggcaccagttggaggaaacagagcgaggtatcaccaatatgctgaacgctatccagatggggattataaacgcctccaccaaacagcggcttgacgagttggaggacaggaaagcggatatagagctgcaaatcatccaggaggaaatgaaacaccccatgctgacccgtgaggatgtgacatactggatttgccgtttccgtaccctggatgtgtccaagctggaagaacggcggaggcttattgacagctttgtaaactccgtgaccgtctttgacgattacattttgattacctttaactataaggagggcgaggaaaggcttgattttactgacattgagagttcggatttacaatcggtcaggggaccatttttgccaggaaaaccgccttaataggcggttttctgcgttttaagtttgatttttttagtttcagctattgctgttcagcggtgattcaaggctcagagaggcggtaggcgcatgagtgagaatagcggctgaaaccgccaaatccctaacccgtcccaaattggagtgaccgccgtatttttcattgtagatacgacgaattcttgagttttccagccctatcctttataatggttctgtggtgagcctttgcgccaccaaggtagccgtatgggggtatatttccatgcggctttttgactttagaaaccagatggagatgatggcatgctcaccaataaccagatttcctatttaccatatgatgattatgcccagagtgccaatacgctttttcatttcatgaaaaagcaagaatacttaaactccattctccgccgcagggccataattccacggtattgtgttgaaaccatagactacctaagtatcaaaaatggcactcgtttatttaacgaagtcgctattttgcaaaagtgtttctgcgatattccttttcacaaacttgcagattcattcgctgtaaatggtgttggcgatgtttatgaatccttaagcaaggatgaacgggctgatctcgaaaagaacaacacacattttgcttattatggagaatatgcagtagctttttcgaaaagttggggtgaaaaaaagcatcttcagccggttcactatcttaacaaagattcccaatatgcaaaagatttttctgctttatttagtcgagttttcctggatgatgacattccagaagaatattctcaggatataatcaatcgtttagcgtacatcaaaccattgcgaggaattatgaagagaaaaatcacccgcagcgattccagttctgctacaattgaaatctacaaaaattttcatgacgagcgtgaatggagatatgttccgaatgttgaggcccttactgatttgaatacagaaagcatcatcgctaatccttatataattcctttggccgacgaaattagcaaggggttagaacaggatagatacaaaaaactttggcttgacttttcgtatgatgatatacggtatatcatcgttccggatatcctctcccggattgaaattattaacactataactgatctacctaatagttgtttcgaaaaccaggacgatattttaatgcagaagaatgttttgatcagtaaaatcctggtgctggaagaaatcagaagggactggtaatatgccaaataaactcaaagatattttttctgatgatatgtttaatatgagcggcactctgcattttagcgacggagaggcatataagaatttcttatctgctttggaaattgtatacgcagaagggcgtgtcgttcctgtcgaaggtgttacttcagtttctacaacagtcggacacctgggcaccaaatttccattagaagaacaaaccaacataacccaattcttggttggcccgacggtagaacctgtgcctattacacttgatgtagacggagaagaaaaaactataacgctgttgcgtagtcgaattaaagataaagtaattttgcgttccgagcctgattccattgttgtttttaatattgcattcctacttggagaaaataaacatacccttaattataagacgcaatttgagaaagcgaaaagtattggagaagttgctgacagttttggtatcgctgcagcactcttggcgcatttttataaccgcgaagaaaacacctcctctgaaagcggaaatatttccatatcggatataaaagagtatttccgtcgctacacatctttttttaagcgtttaagtgcaatagagagcaaacttgcgatttcaatttctccaggtttgttgaacgccttatccctggaagaacagcgagatattgatgagctttatttgctcctatgcgagaagagggttgttcgcttgaacgccaaactcacagacacgaactcgacatctatgactatgagcaatccggaaagatctcttagtattggcagcaaaattgcgttaactttcatcagtagtattgagtttaatttcttaaagcagtccgttaccctccacactgcgaatctgttgataaatgcgctggtgaaagatattcaagagtgtgatgacggcacagtaaagattatgtatggtgatactgatagcaaacccatgtatatttctttttccgcattcgaaacaagcgaagaagcaaagcgagaattagataccatattgcagcacgaagaaatctatgtcaatgccctaacaagcaatgcatatattaatcagtactatgaagagtagcattaagatatctacacatcaacaaaggcagatgcccaaaggacaggtccatgtcctttaggcatcctttgtttcaccccactctctcgaacggtatcaccttataccggctctcttcgggcgggtcaggcggcaccggttccgacttggctgtggccgtttccatgaagccgccgatcttctccgctacaactctctgcatatgtgtataggtgtccagggtaaatccggcgctgtagtggtggacagcattttcacatccacaccgctggagaaggccatggttgcgaatgtgtggtgcaggttgtgaaaccgaatctcaggctgctcgccccagcattccccgtatcatctcataccacttggctgccgtatgccgggtcaccccggcaccgcgggcgatggcccggcagctggtcacgtcggggtggaatttcatgtacgtccagatcttcttctgagtcttggtgagcttgtccggcggcgtaacgccccccacctgatcaagcagggcctgccgctccgcctgcattttctgaatgagcgcgttcaatttcttctcgcattccttccgggtcttcgcgtagacgttcttcgcgtggcgcgtgccgtccggccaggtgggggagtaacggccctcaaacagatggtcattgatctgggtgatgcacccggtgccgggcttccgggtctttctcagcaccggctggaagtctgcggccgggttttgctctgtctgcgcggattcctcctgtacctcattgcccagtccacggtcgatcttggccgccgccgcgctctgcatatccccggtgacatgggtgtagatgtccagggtggtggccgccgacacatggcccagcatggcggagagggtcttcacatccatgccgctttccaaggataatgtggcaaaagtatgccgtaaatcatgaaatctgattttcttgcacccggcccgctccagaatgatctggagccgccgacgcaccgcgcccggtgtcatgggcatgtcctctttgaccggcgaggggaacatccaccgggagtccaccgtttcccggtattgccgcagcacctccaccacgccgggcggcagaaccagcccgcggatggaggcgcgggtcttcgggatgctcacctggagctgtcccttcacctcatagacctgcttattcacggtcagggtcccggccttgaagtccaggtcgtcccactggagagccagcagttcgccccgccgcaggccggtgcacagatccaggagaaacagttcgaaataaccttccgcctgggcctggatgaggaaccgctggagctcctcccgacccagcacctgcatctcccggccccgcttgggcggcagcttgcagcctaccgccgggttggtgcgaatcagctcctcctgcactgccttctccagagcggaccggcaggcggcgtggaggccgcgcaccatggagtcggacagccccttgccgaattgctctgtgcggatgagccgtccagccgttttcatccgggcatagaactgctgaaggtccttctgggccagctggttcagggggatcttccccaactccgggatgatgtgctgatagatcttcgcctcgtagttggcctgggtggtggggcggatctggggtttcacatagttctgataccagaagtccagccactccccgaagggcatctccggccggaccttctctgtttgggagccggtcaccgtctcccggagctgtttcagcctttcctggcactcccgtttcgttttggccaggacattcttcgtcttgggcaaccccttctcgtcgtagccgatgaccacccggccctcccagcggccgtctttccgctggcggacggagccctcgccctttttccgccgtttagccatggcaggcacctccttccggcctgtttctctgccacggtttcaggtctttccccaggagattttccagaaagccgcccacgatgtggctggcctcctgctgcatgtccggcgtcacatgggtgtaggtgtccagggtgaagctggcgttggtgtggcccaggatgccggacagggtcttggcgtccacgccgctggtgagggcgtgggtggcgaaagtatgccgtaaatcgtggaatcggatcgcaggcagcccggcctctctcaaaattcgcttcatccagtagtaggcggcgctggggcgcaccggtttctccggagccagcggttccgggaagatccactggctgacggcgtgtttcttccgctccttcagacgctggacggtgctgggcggcaggcggatggtccgccgcccctggctggtcttcgtctcgccgatctccagctccccggccttgaggacgttcacggaccgaaggatcttcagcgtcccggccttctcgtcgaagtcctgccacatgaggccgcagatctcgccccggcgcaggccggtggtcagctccgtgtagaagaagtcccgccagatctcgttgcggtccaccgccgccaggaaggtgtccatctgctcctttgtgaggatctgtttgggcttatagttggccttgggcactacggccccgtcggtagggttccgggcgatcacatgggccgcctccgcgtccttcagacaccggtggagcatggcgtggatgcggagcaccatggtgtccgacagctcatgcccgtgttccgggtgctcgcggacacggccctcgtgtttcagctttcggtacagcttctggatgtctatgcgggtcactcgggagacgatcttatcccccagatagggtttgatgtagcaccggataaactgctcgtagctgcgcagggtgttgggccgcagggtggccgcgccgtagtcctccatccactggtccagccactcggccagggtcatgcggctgtcctcagtgagctccacatcctgaaatgcctccaggtcccggtggagcttgttcagcagttccttctgtgttttggccaggacataccggaagatgggctcgccgttttgcttgtggcccaccacgatgcgcccctcccagcggccgtcctcccgctttcggaccatgccgtcgccggacggtctgcgttttgccatatcatctcaccttcatttccatcgtctttctggctcgatcctcctcgtcatcatcgaaagagtagggctccagttccccggcgatgcccagccccaatcggaatccagcggtaaagctggctagggagacttcttcccggagcatattgtgtatatccaccagacgcatcagcttatgccactgcatggtatccaggcaagcctgtacctcccggcgggtttgctccagctcttgttccaactctacgaaatccgtctcccgaaagaaccgctggtgtagagccctcatgtagtcgttcatgtgtgccgcctccttatcagcaacacacaatacccgaacttcctcccaatagctacccccagcggcgactgttttcagaaagttatcatttgccggcgaggcttttctctttgacttgcggggcagtttctgatgtgcctgccatagtaaaacgtatgtcgcacaccgttgcaccgcgccactctgctgaatgagagccctttggtcgttctcgacctatgacaaccgcttgtatccatgccagccctgtggtaagatgcggttatcccatttcaggcaggaggcgcgggcggtgatctactgtgtgtcagacatccacggtgagctggacaagtttgagcagatactggagctgatccacttttccacagaggatcatctctacatcctgggcgatgtgatcgaccggggtgccctgggggtggacatcctccggatggtcatggacgcatccaatatgaccatgctcctgggcaaccacgagcagatgtgcctgagcaccctggggccacacaacgaatttggagcccgggacctctggcgaatgaacggcggctcgtccacctatcgggagttgctctatcgccggacgcaccaggagcgcagcgagatcctgcgctttctctccggcctgccgaaccacttgaacctgacagtgggagggcagaagttccatctggtgcacggatacccgggagacgaccacgacacccgcatctggggccgtgtagaggtggacagcaggagcccctatccggataccatctgtatcgttggccatacgcccaccgtattccttacagacaaacatgatgaggacttctccatttggcacggcgacgggatcttcgacatcgactgcggctgcggcagcaggaaagcggttcaccgccgcctggcctgtctgcggctggacgatatggccgagttctatgtgggcggtctgggcggcgatgcggttgttctgccgccggttgaacaccctctttgacaacttgagtcctggtataaaccgccgcctcccgcatttgcgggaggcggcttacgtataacagctgcctactctgtaagtggtctgccctgggtttgccgctgccagcacttctggaacgtgggcacgctgcccagcttcttgacctcctgcgcactgtcctcctggatcagggacagctcctgttcgctgatgttcagcaccacggacagcagtcgcgccaccatggccagctccactgccatcttgtactgcccggtacccagggacttgcagagggtttcaaaccggctcccgtcaaagccgccgcccggaagctccgggagctcctgccggagcagctgatcggcatagcacacgatggcccgctccacaaagtcgttccgggagcggacgcctgcgcggcgcaggttgtcatcgcacagcttcaggtgcctgggagtcagggcgatgcccgccttgatccgtttctctgtcatattgtcgtctcatctccccggtaccgggggcgtccccccgaaaacgctccgtcccgcatggtgttcaggcccccaccgcaccggtacggggtaccaatccgccgcaaccgccgctgtaaccggtaccaccggcccgccctgcgggcccggcgtttccggggcgggaggcacctctcaggtgcacgcccctttatcctagtacttttttcgaacggccccaacagagcctcaaacggcctcaaatccgccggcagggggaggggctccagctcgggtcaacggcccgcatagagccctgtgggcggtcacaggtgccttcacggggaggcctcctcatgggcggggccagcatccggcgacggagtatggcgtcgtacaagcgcacactggtgcgcatctcgcagatgtaccttctggtgtccagggtgccgcgaacagacagctccggctcctgctccagcagtgcatctatccgggacatcagcacggtccgccgccgccttccccctgaccttccgtgcgatttgccgccagccagcgcgcctggagttcctccgcccggcgcagctgccgcccgtgaaagtcgtcgatggccatctggatgggcagtaccgtgtagcgcaggcagccgttctgcctgcggccgtcccgggtgatgacggtggtgcgctccgtgcggatgagctgccggtcctccagctccgccacatacttgcgcactgtgttcacgctcagatgtaccgcctccccgatggtccggtagctgagcacgcactgccaggtctttcggttctcccgccggaggagaaacccgtagatcgcgatcgcactgtgcgacagccccagtgagtagagctcgttgggcagcggaaagtagttcttgatgggatcccgtctgggccagcgtttcgtactcattgcgcacctccggaccgctcctccgtccagcggaggaactgctcacggcccaccaccatgcggctgcccacgcgcagcaccggaaagctctgcttgtgcatcagctcataggcggtggagatggatacccccagtacttgcgccacggtcctcgcgttgaggaacagcggcagatcgtcgtaactcttgtaggacgacgttttcaatgttatacctccggtttcttcagattcagagaaaaacttcttgcgtttcggaggcccctctgttagactggacacagaccgctctgtgtttccaaaacgcagcgggccgctggactgttgcagcagttcagcggctttcttttttcaggttcataggattgccccctttttgtgttcgcggccacgcatcatacccgttcctgccctgcggccttgtttgaccaacacagcgttttcttcccccttggtacgctcggcttcgtcgccgtaaactatgtatcattcgtttccgggcttgcccgaaaactcattcacaccgttgcggcccctcttcccacaaagtctgcgactttgtgggagccctgttaggcggcgtcctggcggtacttccccggtgagtatcgtctctgatggtgggtatccggttttcaaagtgcctgcggaaggaaacctgtctttctcttgacagacagctctttcagtgatagactatcataaattgaattaggcagttcttccgtggccttatcttactactcgtttccgccgttgtcaagacttatagtaatataattttaaaattgtctattttaaggtgactgatatgtggtacggtaaaatgtatttctccggaaagcatgagttttttcagtacgatccctccggggttcagcgcgtgccctcggtctggaaggagcagccctttctggagagtttgctcacattcctggagatggactgcgcggagttgataccggtcatccggcagattacagacagctgggagtccatgctcacgagggacgacaaaaatgccagcctcgacgccatgaaggggctgggtttgctgggctccaagcacatctacctgtacctcctgtacgtgcgctggtacgaccggctcacccgtattggcatctaccacgaccagggcagcccggaggatcagcagatgctggacgagctgcggcagctgccggagcagctgccccggtatcagaagcagatccagcggttcttcgacctggtcctggatgtagacagggccgggcgggagccccagcagcaggcggccaaccactacctgtatgacgcccccaaggatccggatctgtttgtctttcgtcctatccccctcagcttcgagccgatggagccgggccgatgttccccggtcctgtaccccgtccacgtgccggacatgattgactactccctgcgcagctgcgtggagcggggcatcaccgtccggcgctgtaaaaactgcggccgctatttcccccagaccggccgggtcagcgcggagtactgcgaacgcccggctgccaaagggcagcagacctgtcgggaggccggggccttccagcagtggaccaggaagcagtctgacgatccggtgttcaaggcctaccgcagggagtataagcggcgcttcgcctggatcaaggccggccgcatctctgacacggatttctacgcctggagcgagcaggccagagagatgaagaagaagtgcgaccgggatgtcattaccttggaggagttcaaggagtggttgaaggagtcgtgaaaacaaatcatccgaaaatgagcgacgggatcggctgagcagccgatcccgtactctttgaataggtaatacagattttgagggacatacaggtgtcttgcctctcgtcgccgcgtctatagctcggtttcatagggccaggtgttgataccgccgaattcatagatgttggtgtagcccagctctgccagggtagaggatgccgtcttgctgcggttcccgctgcggcagtagactagaacgatggagtccccctccgggatgacggcggcggccgtctcctcgtcgatggtccccaccggcaacagaacagcacctggaatgtggccgctgtcgtattcgtcctgttcccgcacgtccaggatgatgacctcctgggtgtccatcatctctttggcctcctcctgggtgatctgctggtagccatccgaagagtttccgccgcacccggtcaacagcagaagagataaaagtataggcaggattcgtttcatttgagttcctccagaagttcggcggcaaaggttttgtgcccctgctccgtaaagtggacgccgtcgtaggccaaagggatgtcccacttcccggcgtcggcgaagcggatgcccagatgctccgccagggtctgacagagtctggcatagtcacgggagtcatcgatgagtttctgactggggacccacgcgcccagctgtactggtggtggggcaatcagcaggattttacttcgattcaaggatatgccggagagaaaccgcttcagactcacggcggcctgttccgggcttctgccttggagcaggtcgttggtaccaagcatgacgatcagtagatctgtgttggtagggaaagaaggcgcagacgaaggaatctcccggccgttctctcccatgttgcagactgtccagccagtcttggctgccaggatgtccacccatcggctgtccgtgtcatagcgaccacccaaataggaacggggatcgtagccgtaggtgttggaatcgccgaagcagatgacgttcattttgtgtttcctcttccaaggtattatactatctgcggtgttgcggaaaggggcaactgtaattttgctgatggttcatagtcgatgtgatcttagcgcgacaaagttacatgcttacttggtccgtccacatctcgcactggctcattacggtctgcactgcatcctccataccctctggtggatacttgtgctttttgagtagccgcttgaccaaccttctcatgccagctctggcgctttctttcttctgccaatcaattgttcgatttttgcgtaacaaatcggtcagttccttggtgatggcaatcaactcgtcatgctcataaaaatccttgatagcctggggctttgtcagtgcgtcatagaaggcaagttcttcggcggtcaggcctaacttttcaccttctgcatttgcatcagcaatctccttagccaatttcaaaagttcttgaatgacttcttcgttggtcaacatcccattcagatagcgattcatagtggactggataatttccgaaaacttctgtgacttcacaagattggttttgcggtagacagatacctgttcagaaatcaactttttcaaaagttcaaccgcgaggtttttctctttcatattggcaacttcttcgaggaacttcgggtcaaacagggaaaactcggtgccgatattggaaaagagattgatgacaccctcgctcttgatactgtgtttcagcaattcattaatccgctcgttgacctccggcaaggtgaacttcttcccggcgccgtcggtggttaagcggacgagcatcgtccgtaccgcctcgaaataggccgcttcaaaacgggtctgcgcatccaccatgctgctgcacagggagagggcctgcttgagcaagagcgcctctttgatgtagacggtctgtgtcttttcggcatccggcagatcatgctctgcaaccgacttccccagcaggagattgacgccgccgctgatcatccgagctttctccaaatcgtttccggtcaggaaactggtgtagtcaaagccatggaacaggtcgcggcagacttccagcttttccaagaacttggggtaagcggccttccccacgtcagggtcgccgtagtttttcttgtcacggacggtatagtcattcatggccttttttaaggccgaggcaatccctacgtaatcgactaccagcccgccctctttgtcacggaagacacggtttacccgtgcaatggcttgcatcaaattgtgaccggacatgggcttatacacatacatggtggcaagggacggcacatcgaagccagtcagccacatatccaccacaatggcgatcttcaatggggaatcgttgtccttgaatttccgggccaaatcgtccttgtgggccttgttgccgatgatctgtcgccattcctccggatcgttgttgccctgggtcatgatcaccgcgaccttttccgtccaggctgggcgcaattccaggatacgacggtagattttcatggcgatagggcgggagtacgccacgatcatcgccttgcctgtcagcagatccgcccggtaattctcgtagtggttcaggatgtcactgaccagcgagtcgatggtctcgtccgcgcccaggatggcctccatctggcccagttcctttttgcttttctctatgacataggggtccgcattctcagccatcaggtcgtattcctgatcgatcaggcgcagggtagtctcatccagcttcaggtggatgacgcggctctcgtagtagaccgggcgggtggccccgtcctctaccgcctgggtcatatcgtaaatgtcgatataatcgccaaatacttcccgggtgctgcggtctttagaggaaatcggagtgccggtaaacccaatgtatgtagcattgggcaggcggtcccggatgatgcgggcagtgccgatggaggtgtggacctccagctcgcccttctcgttctgcctggtgaccaccttctccgtcaggccgtactgtccccggtgggcctcgtccgccatgactatgatgttgcgccgctcagacaggggttcgccggtctcctcaaatttctgcatggtggtgaagatgataccgttggcctgccggcccgctagcaactctttcagattctgtcggctctcagcctgctggggcgtctggcgcagaaagtctttgcatcgggagaactgaccgtagagctgattgtccagatcgttgcggtcagtgatgaccacaatggtagggctctccagcgtctcctgcaaatagtgggcataaaaaaccatggacagtgatttcccgctaccctgggtgtgccaaaacacgccgcccttgccgtcggtcacggtggcgtgcttggtggactcgatagccttcttcactgcgaaatactggtggtacgccgccagcaccttgaaggtgttttgcccgtctacattgaaacagatgaagtttttcaaaatgtccagaaagcggctcttttcaaacagcccctcaaagaaggtatcaaactgggcgtactgggtattttcgtagctgccatctttggttttccactccataaagcgatcctcgccagaggtgatagtacccgccttggaggtggtcaggtcgctcatgacgcagattgcgttgtagatgaacagggacgggatctcatacatatagttgcgcagctgccggtatgcggccgaggcatcggtctcctcccgggagggggacttcagctctaccaccaccagtggcagaccgttgacaaacagaatcacatccgggcgtttctcggagttctccacaatggtccactggttgacaacggtaaaatcgttgttggctaggttgcggaagtcgatgagatagaccagggcggggcgttcctcgccgttcacaaaatatttgacgggcaccccggactgcatatagtccgtgaaggtcatgttcttctggagcagggtgccggtctcaaagtttttaatcttgtagacggcctcgttcagcgcctctatggggagccctgggttgatgcgctgcaaggcggggagcagcagatcctcatagagcgggtcgtggtagtcccggtcaatgtccgggccgtaggcgtaggagtagcccaacacatcggtgaacagattaataatcgcgttctcatagttggattcattgtatagtccaatcaatatgatcgcctcttttcagtacagcatcatatttgatccatgtaatgctattgataaagtcttcctgactttttgtatagtgtgaaattgtataattgtaatccattccattatttgtaagcaattctgacattccagcaccaatgcaaactctgcaaaattcgcctttatatgtttgcaaattaacatcaaaatcaactcggcaagattttcgttcaaacaagctggcctcaagcctgttggagtacatttgaaggacatgggggaataagtctcccagctcatcttcatctgctaaaatcatttcatctggaatgacaatcttaaatatatacccgtaattttcttcctcaacattcccgtgtaacatggcaaagcgatatgcccatgtaatttcattggacagatatacaaacccattggagctaaaattggccccattgttttcctttgtaaaatagcgtggcgcgtcttttttaattattcccgattcaaaaatcaatttggctcgatattgtgatgtgccatgatatagaaccatccaagtcactcctataaacgataatttagcggcttagagctcgacggcggagacatcaagttcgccggacatcagctttggcagaagcgcatcccgcagttcagctaacctgatattttcgagagagttgtaacgcattttaagaaacatcggttttactgcctctccaaacttcaatagactctgttcatcaaatttggggagccggaactgccctattgtttcagcggaaacacgctgtcttccgctgctaccattcatgtttttgactgcataatcgacaaatgcgggataacgagccaagcagtacagcatttcagacgggacattctttcttggggcaagtacaatgtactctgtcgaaccaaaggccacttcgccttcatcgagaaagtcaatgaaagcggtcttaccgttttcaaggcatggggtaatacgcgctaaaagagtgtcaccattggcaaagcgcattcctccgttaaatggtttcatttcccatccagaaggaaatgctccgcttgttgataactgactcatgtcaatacttcgagcgatttgatgttttgccaatacccgtcttggattgagatctgcataatcagatactatgcagtcatcattgtcagcttcaatcatgagcctatcaaagaaagcaaaggcttgctgctgtaaattatcgtttatcttttgattaacggctattttttggtcgaacatatacaggcactccacaatcttcttttgcatatcgatagatggaagagatagtgtgactgcatttaaattggcttgactgagtttgggttgtgccgatccggtgacatatcccgacaagtcaatactatttaacaggtaacacaaatagcgggtatcgcataaagcgtttccttgaacaatatgagcatggttattcacccagaattgtccgtcaactacttgggcgatattttgcttttttgatttaaggttctcaccatcttccgcaattaaaagataggttccgtcaaagataaactcatcaatatgatcaattaccccctgcgctccataatagcgatatttgccctgccgtttttcgcgttgagcgccagaaagcggaactcttttcttatcaaagttaactgtaatctcgtcgaatcggtattctttaagttccatatttgcgctcctatccaatgtactttctgtgtgccagtttcacattttgttgtttcaccatcgcgtagtgcatggtggtatctttttttaatgccccaagagctgttgcacctgctcaatgggcattcccttatctatggctgttgttgccattgtccgcctaaatttgtgcggatggacttttggaatgtgtaatttctggccaagttttcgtagccatgtttccacgccgccaatttgcaatcgcgcatagggagcccgaagggagacgaacaacgctgggttatcatcccgccgcgcatccacataattttgcaaatggatcttcgtcctggcatcaaagcagaccagccgctccttattacccttgcctaaaaccacgcattcccgttcggtgaagttgatgtcctcacggttcaatgtgaccagttccccaacacgcattcctgatgatgataagagatcaatgattgccaaatctcttgctgtggtacagtgatcccgcatgagttccagtgcttcgtcagtataggtatctttgatcactttggccgttttgactttatggatgcgccggatagggcttttgacgatatagtcttcatcctccaaccaagagaagaaactagacaggattcgcctgatgttatcaatcatcactttgctggaaccgcgagcctcttgataatccgtcaaataccgacgcaggtcatccgtcacaatctgctgtgggggcctgtcaatggccgccagcatggtcgtgatggtttttctgtaataggacaacgtcttttcagagcatccctctatgcgcttggcggtgataaacaatgctacagcatcataaggcttgtccggcttggcttccgtattttcacagatcgagaatccgtataaggaatgctccaaagtatcccggagctgaagcatttgctcattattgagatagggcagcatctgttgctggatttcgttgattagctgttctttcatcgtcgagtctcctttgcactataagagaacgacgagcagcggcagttccttcgaataagctctcgccgctgtcgagagttcttgctctattccaccttgcgcaattttctggacgaccctcctacatatatgctcttcgctatctgacgtaaatcaaaatcctcatttgaaacaatattatcgattggtatatgtacgttaattgtagttgtgttgctttccagtgcgtcaaataactctggattagctatgaaatagtcttggataggtaggtagtatacaatcccgtgatccacatcgacataaaacaaaacaaatgctattggacttgataggccatagttgattgtttttttctccatagcaaatgaaaaaacatcttttcctttgaggcgattaggagatcgcgtacctttaatctgtccttctatttttttgttgacaaactcatcactttcaaccaattcaatagaacagtcacggcctacatctctgcctgtttcttcgtggtactcccagtgctctgaaggaaaccgataatgaactaacttccttgcttccgcgctaataacccgcgctgcacaatcttttggaagccctggcaatcatctcaccacccctatgttaaacgataatttacagcagcaagcctttgctttctttgataggctcatgattgaagctgacaatgatgactgcatagtatctgattatgcagatctcaatccaagacgggtattggcaaaacatcaaatcgctcgaagtattgacatgagtcagttatcaacaagcggagcatttccttctggatgggaaatgaaaccatttaacggaggaatgcgctttgccaatggtgacactcttttagcgcgtattaccccatgccttgaaaacggtaagaccgctttcattgactttctcgatgaaggcgaagtggcctttggttcgacagagtacattgtacttgccccaagaaagaatgtcccgtctgaaatgctgtactgcttggctcgttatcccgcatttgtcgattatgcagtcaaaaacatgaatggtagcagcggaagacagcgtgtttccgctgaaacaatagggcagttccggctccccaaatttgatgaacagagtctattgaagtttggagaggcagtaaaaccgatgtttcttaaaatgcgttacaactctctcgaaaatatcaggttagctgaactgcgggatgcgcttctgccaaagctgatgtccggcgaacttgatgtctccgccgtcgagctctaagccgctaaattatcgtttatcttgttgttcagttcaattttatcatcaagtacacaaagaaccgctgcaatctgtttttgcgtcagcaggggaggcaaatcaatttctacccttttcaattctgccgccttaatgccaatcacagtagttccggtagcgcgcgcttctattctgcttttgagtacacagtcctgtaaagagtagaatagataatccggatttagatattgttgcttcgactccaaaacaataatcctttgggcaaatgccaatttatcatttgtcctgatgcgtgctacctctcccaatggggcttcggtcgtaaataccacagagccctgcttcgggatgccccgtctcatccactcatcatagtagctttcggcaataaattcctggggttcctgaattgcgccgtttttgactattttcgccgtgatcaatggaatcccgcttgtagtctttggtggagttttgccacggtaatcaataaacgtacatacgtttcctaaacaatatgtttcacacttcatacccaatcgcccccagccgctccttgatctgtgcctccagttcgtgggacttcgcaaagagttcggacagttcggaggtcagccgtcccatcttttcctcgaatggttcgccgtcgtcctcctgctcctcgatgcccacatagcgtcctggcgtgaggatatagtcctgcttggcgatatcctgggtggtgaccaccgcgcagaatcccttgacatcatccaaggtgccgtccacaaaggcgttataggtggaagcgatcttctgaatatcctcgtcagtcagctcccgcagcttgcgggtcaccatagtccccattttgcgggcgtcgataaagagcgtcttgcccttctgcttcttgtttctggccaggaaccagagggagaccgggatctgggtggtgtagaacaactgggacggcatggcgacgatgcagtccaccagatcgtcctcgatgatatttttgcggatctcgccctcgccgccggactgggaggacagggaaccattggccagtaccataccgatgcggccgttgggggccagatgccagatcatgtgctggagccatgcaaagttggcgttgccggcgggcggcgtgccgtacttccagcgtacatcgtccagcagcttttcctgcccccaaccggagaggttgaagggcggattggccatgatgtagtccgccttgagttgggggtggcagtcgttgaagaaggtatcggcgttgaatttgcccaaatccgcctcgattccccggatggccaggttcatctgtgccatcttccaggtggtggggttggagtcctgtccaaatacagaaatcttgttaatgttgccgccatggttctcaatgaactttgcggactggacaaacatcccgcccgagccgcagcagggatcgtagacgcggccatcgaagggctgcaaaacctctaccagtgtgcggaccacacaggagggggtgtaaaattcgccggcattttttccctcctgctccgcaaatttggcaaggcaatactcgtaggtgcggcccaggatatccttgctctcgccgtgctcgatcatctgaatattggtgaacagatcgaccacttcgcccagccggcgcttatccagttccggccgagcaaagtttttgggcagaatatccttgagccgcttgttctctttctcaatactgtgcatagcatcatcgatcaccgcgccgacttccggcgtatgagcggcggaggcaatcacctcccaccgggcgttctccggcacgaaaaagatgttttcggcggtgtactcgtccttgtcttcctcaaagccgtcaccctcctcgaccaattccctgtacttggcctcaaagcggtctgaaatatatttcaagaaaatcagacctaaaaccacggatttatattctgaggcatccatgttgccccgcagaacgcaagcggcatcccaaatttgcttttcaaatccgatgctgctggaattggtttcgttcatagatactcccctcgttatgttaaaatgcgagactcttctttccttattatagcaaatatagtatcaatatcaacgtatgcaaacaatgcatagagccttgagttcttaaaagtggccttacaaactcttatagtaccgttttatcattgccgccatcaacttccgccgctccgccaaaaaagcgtcatagcacgaggcgtccatctccacgatcgtcggaggaatgcagttctcctccaaatttagatttaaagcagtggtatctgtgatatttccgaaagagggcaccttagattcacattgctggaacgcccttttgaagtaatcacagggtgccgagtcactgatcgctttattgatttgtgtatctaagtaaatgtaattggcaacctgattatatttcgttttactgtccacgccattctttttcaaataggcgcgtggaaagatgtggtgaatgtccccggaaatcgcaatcaggtcgctcacctttgtaccgtgcatcaggagcgagtttgcgttcaaacggatctgggcggccagaaatacgttgaaaaccgggctgttgacagcggacgtctccagattctgcggtagcgtaacgaaccagaaattatccgagagcgcggaggcctccacttcctccaggaaagcaagaaaccccttttcttccatgctgcgcatatcgcggtccatctgggattccggcgagccaatgtagcgggaagtaagggtggacaggacgaaccacttctgaacataccgcttgatctggtcgttgggaatcgcaggatcattcaggagaagcaggtagagagtgtacgcgaaatccattgtcatagctgagttcagcagcttgctggaacagaagccggcgcctttgatcgccaaaacgaattgatcaaagttatagtggttcatgaaattcaaaaggccctgatccagcttctggtaggagtcagcgacaatatcctcccggaactcctttgtcttaaaatctctgcccgagagcaggctcaccagatccgcgagctttcctcgatggaattgatgcatgaaggacacccgcaacatatcgccataatccgggtcgtagatgtcctcataatctttggacaaccactggatttttgacgcatactttgactgctggaattctgaatcatgagtcagctgggtataaaattcgggtttcacggccagatggcagaaataatctactgccttccgcataaggtttcctccgtgctccatgtccgccgccatttttgacatgacaaagtcggactgactcaacggcgtacccttggagttgatacggatgaagatttccgtcacttcatcaatatccagcgtatggttcagttcaatgacaccgatctgtcgattggcaatgcctttcaaatcattgagtgcgcggttaacctcattgggcgtaatgccgtcattgctctcacagtagcgaatggagaaatcaaatggatcaaattccggtcggaaaaccacagaaatgtccggaatccaccgcttgtccttcaggtgagaggcatcctgtacggcaaagcgtttgctatcatctgaggccagaggattgaacgcaatcttaatgcggtcgcggttaaagtcctcatccagaacctcctgcccggcaatggctgccatcaatgcggtgatccgctgctggccgtcgatcaacactttcttcccgttcgaccggccgccgtcttttgtccggacatctggatttttccaagtgataatgtagcctgtgggatagccctgatacagagaatcaatcagatctctcacctggctgcgcttccagacaaacggacgctgaatttccgggataacaaaatcctcagccgcaatcaggcccagaatcgcacttaccgggtactgcatcaatgtaaatttttctcccgtcatcgcaaaagctccttccctgcccatgtctcagtatcgaaaaagtcatcttaccctttgtctggtttcgaataatattttcttcagtataattggaattccatgattcgacaagtctttcttggtaactatccacaaggacgatttcgagaataaataattctaccgcagggcatgtacgataaacggggctattctgcacaacctggtttgcttgccacagccgttttgtttcggtacaataggagcagggcaatatagagcggcaatttttcaaataggaggagtggaggactctgtgcatacagtttcaatagacggcaaagcggtatctgtctttcttggcaacaaacctggcattcccgtgatctacctgaacacatactccgatgaggggcaacaggtatttgaggcggtgcaggccgttggttgcctaccgtttaatttggcgaccatcagcaatttggactggaaccacgacatggctccctgggacaatccagcggccttcaagaagggagaaccctttaccggcggggcggatgactacctgcggctgctggtggaggagatcatacccagggcagaaaaagagctggccggtcctccggcgtggcggggaatcgccggatactccttggcagggttattcgccctgtacgctatctaccagacggatgtattctcccgggtgggcagtatgtccggttccctgtggttccccggtttcaaggagtacatcttcacccacgagccaaagcgtcggccggactgcatctatttctctctgggggacaaagagtccaagacccgtaatccagtcctgaaaacagttcaggaaaatacagaggagatccgggctttttaccaaagtaaaggtatcgacacagagttccagatgaatcccggaaatcacttcgtccaggggattgaacggacggcggcaggcatccagtggctgctgaacagatagactgaggtccgtaggcttttattctttgaataggcgtgtgaaaaactgatacgcttaccgcacagaaaagacttgcttaacacccccggcagaggtacaatagcccaaacagtagaaaggattaaaataatgggttatcaccatttatcttcttggcaaataggctgcctgtaagagagcatgtttccttgacgacttttgcaggcggcccgaactgtcaaggagtgagcacaattgaacagagaccgcagttactatcgtaagcagcgtatgcacgcgatccatcgcaaggaaaagatcctccgccagcttgggggagaggaaaatgtccttgcgtgggaacacggtgccgccggacggctgtccaaggggaagattcattgttcctgttggatgtgccgcaggaagtcgtatgacgccccccagattcgggataagcgagcggccatggatgccgtccagcagctgctggaaatcgagtaacttttctcacgaaaaaacgcttcccagccggggccggcagagatctgccgcccctggtcaggaagcgtttttgaccccatatttgaccacagtcaggactggaatacccggaaacagtggatttaagagcgtcaaaaaatattcaacaccgagcggaaaacgccggaaagcactgcaaatcactacaaaaaatttagttcaagcgtttgggagcaagatgccgggagttcgagtctccccactcggaccaaaatccgtcaaaatcttgtgattttgacggatttttcttaatttttacaacaaaactattttattagatttcactatccatttttgcttttcttgaggtgccgaaatatggtaatagagacaaaccggctgatcctgcgcccctttttagaaagtgacgcggcggatgtttacgaatatctgaaagagccagcggtcaactgctttgccagcatgaaaatgaactccctggacgaggcaaaagcggaaatgaaaaagcggctcggcgagacggagtactacttcgccatcaccctgaaggaaggcggcaaggtcattggggagatcgacgcctacccggaggcgggcgagccccatgcaggcgaggacgccccacgggacaccttcagcccctgctggatgctgaacgaggcctaccagggccaggagtacgccttcgaggcggcccaggccttctttgactatctcttttcccaaaagggcgcaaggcgcatttacgcctataccgaggactacaatcttgccagtcagcacctgtgcgagaaactgggtatgcgccgggagggcgtgttccaggaattcatctccttcgtaaacaaccccgacggtacgcccaggtatgaaaacaccgtgcagtatgccatcctgaaaaaagagtgggacctgcggcattcccaataggcagacggaggtacgatatgggcgcagcttctgtttccgagtatgtggcgtcgctgaatgaggagcagcggcgccatgtcagtgcattcattgactttatgggtgcggaatacccgcagctgactcctaaaatctccttttccatgcccatgtggctgctggggaagaagatgtatgagggatatgtggcggtttccgcggcaaaaagccatttctccattcatttttccgacgaggcgtttctgaaccgcttggcggagagtttgcccgcctgtaaaaagggaaaacggtgcatcaatatcaaatacggcgatgaagtgtccctccatgcggtggaaaaaagcatcgacgatttcctgaaattctatcactcggaagggagcgcgtcccaatgagcggcatggaagagatcggctgctacggcgcctactgcggcacctgccgcgagtatttgaaaacctgtaagggctgcaaaccgggatacctgaacggctcccgggatctgagccgggcaaagtgtaggatgaagaaatgctgcctgactaaaggccgcatcacctgcgcggactgcgaggaatatgaccgctgtgagagcatccagtccttcctcaaccaccccggctataaatacggcaagtacaagcaggcgctggagtacatccgcgcccatggccacgccgccttcctgaacgcggcagagcactggacaagcgcctatggcaaatacccgaaacaggattcctgagaaaagcacgaccgcccgctgaaatccgtggatgttcagcgggcgctattctttgtatatgcatattaaaaactgatatgcctgatgtgttcatgaagcagaattggggcaacagtcagttgctttgctttttgctcccgctgtggtacaatccgggcaaggtggtgatcaacatggaacccaaagaaatccttctgaaactgcgcaccaagcggggactctcccaggagcagttggcggaacaattgcatgtgacccgtcaggcggtctcccgctgggagaccggcgaaacggtgcccaacacagaaactttgaaactgctctccgggctgtttgatgtctccatcaacaccctgttgggttcgcccaggcagctgatctgccagtgctgcggtatgcccctggaggacatcaatatcagccgggagacggacggcaccttcaacgaggagtactgcaagtggtgttacgccgacgggaaatttgtctacaccagccttgaggaactgctgaacttcctggaaagtcatatgtccaatggagcctggcccccggagcaagtcagagcctactttgaagctcagctgccaaaactgaaccactggaaatagtctgaactatggaatcaccctctgaaagcgatccagagggtgatttttgtatctatggtcatgagattattccatctgcttctctgtcagcccattcggtttcttgctgttttcccagaattatgtataatggagacaagagtttgcccaggccttttcacatctgtgtcgcttggtaagcgacccttcccgctcttttcagtggtatattctgaacatggaagtaaagaaaatgccctgcataggggccgagaagaaaggcggacagagatgattggtgcaattgttggcgatattgtaggctcagtctatgagtggaacaacatcaaaacgaaggagtttcaaagtttctgtgttgggcaccgtttcgccggtctcccagcgggagaccgcctgacgggtcacatgcaattgttccgccaactgctcctgggagagtccccgcttggtgcgcagtttcagaaggatttctttgggttccatgttgatcaccaccttgcccggattgtaccacagcgggagcaaaaagcaaagcaactgactgttgccccaattctgcttcatgaacacatcaggcatatcagtttttaatatgcatatacaaagaatagcgcccgctgaacatccacggatttcagcgggcggtcgtgcttttctcaggaatcctgtttcgggtatttgccataggcgcttgtccagtgctctgccgcgttcaggaaggcggcgtggccatgggcgcggatgtactccagcgcctgcttgtacttgccgtatttatagccggggtggttgaggaaggactggatgctctcacagcggtcatattcctcgcagtccgcgcaggtgatgcggcctttagtcaggcagcatttcttcatcctacactttgcccggctcagatcccgggagccgttcaggtatcccggtttgcagcccttacaggttttcaaatactcgcggcaggtgccgcagtaggcgccgtagcagccgatctcttccatgccgctcattgggacgcgctcccttccgagtgatagaattttcaggaaatcgtcgatgcttttttccaccgcatggagggacacttcatcgccgtatttgatattgatgcaccgttttccctttttacaggcgggcaaactctccgccaagcggttcagaaacgcctcgtcggaaaaaatgaatggagaaatggctttttgccgcggaaacccgccacatatccctcatacatcttcttccccagcagccacatgggcatggaaaaggagattttaggagtcagctgcgggtattccgcacccataaagtcaatgaatgcactgacatggcgccgctgctcctcattcagcgacgccacatactcggaaacagaagctgcgcccatatcgtactccgtctgcctattgggaatgccgcaggtcccactcttttttcaggatggcatactgcacggtgtttttcatacctgggcgtacgtcggggttgtttacgaaggagatgaattcctggaacacgccctcccggcgcatacccagttctcgcacaggttgctgactggcaagattgtagtcctcggtataggcgtaaatgcgccttgcgcccttttgggaaaagagatagtcaaagaaggcctgggccgcctcgaaggcgtactcctggccctggtaggcctcgttcagcatccagcaggggctgaaggtgtcccgtggggcgtcctcgcctgcatgggctcgcccgcctccgggtaggcgtcgatctccccatgaccttgcagccttccttcagggtgatggcgaagtagtactccgtctcgccgagccgctttttcatttccgcttttgctcgtccagggagtttcattttcatgctggcaaagcagttgaccgctggctctttcagatattcgtaaacatccgccgcgtcactttctaaaaaggggcgcaggatcagcggtttgtctctattaccatatttcggcacctcaagaaaagcaaaatggatagtgaaatctaataaaatagtttttgttgtaaaattaagaaaatccgtcaaaatcacaagattttgacggattttggtccgagtggggagactcgaactccggcatcttgctcccaaacgcttgaactaaattttttgtagtgatttgcagtgctttccggcgttttccgctcggtgttgaatattttttgacgctcttaaatccactgtttccgggtattccagtcctgactgtggtcaaatatggggtcaaaaacgcttcctgaccaggggcggcagatctctgccggccccggctgggaagcgttttttcgtgagaaaagttactcgatttccagcagctgctggacggcatccatggccgctcgcttatccgaatctggggggcgtcatacgacttcctgcggcacatccaacaggaacaatgaatcttccccttggacagccgtccggcggcaccgtgttcccacgcaaggacattttcctctcccccaagctggcggaggatcttttccttgcgatggatcgcgtgcatacgctgcttacgatagtaaactgcggtctctgttcaatgtgctcactccttgacagttcgggccgcctgcaaagtcgtcaaggaaacatgctctcttacaggcagcctatttgccaagaagataaatggtgataacccatattttaatcctttctactgtttgggctattgtacctctgccgggggtgttaagcaagtcttttctgtgcggtaagcgtatcagtttttttcacacgcctattcaaagaataaaagcctacggacctcagtctatctgttcagcagccacggatgcctgccgccgtccgttcaatcccctggacgaagtgatttccgggattcatctggaactctgtgtcgatacctttactttggtaaaaagcccggatctcctctgtattttcctgaactgttttcaggactggattacggtgtcttggactctttgtcccccagagagaaatagatgcagtccggccgacgctttggctcgtgggtgaagatgtactccttgaaaccggggaaccacagggaaccggacatactgcccacccgggagaatacatccgtctggtagatagcgtacagggcgaataaccctgccaaggagtatccggcgattccccgccacgccggaggaccggccagctctttttctgccctgggtatgatctcctccaccagcagcgcaggtagtcatccgccccgccggtaaagggttctcccttcttgaaggccgctggattgtcccagggagccatgtcgtggttccagtcccaaattgctgatggtcgccaattaaacggtaggcaccaacggcctgcaccgcctcaaaacctgtttcccctcatcggagtatgtgttcaggtagatcacggaatgcaggtttgttgccaagaaagacagataccgctttgccgtctattgaaactgtatgcacagagtcctccactcctcctatttgaaaaattgccgctctatattgccctgctcctattgtaccgaaacaaaacggctgtggcaagcaaaccaggttgtgcagaatagcccgtttatcgtacatgccctgcggtagaattatttattctcgaaatcgtccttgtggatagttaccaagaaagacttgtcgaatcatggaattccaattatactgagaaaatattattcgaaaccagaccaaaggtaagatgactttttcgatactgagacatgggcagggaaggagcttttgcgatgacgggagaaaaatttacattgatgcagtacccggtaagtgcgattctggcctgattgcggctgaggatttttttatcccggaaattcagcgtccgtttgtctggaagcgcagccaggtgagagatctgattgattctctgtatcaggctatccacaggctacattatcacttggaaaaatccagatgtccggacaaaagacggcgggccggtcgaacgggaagaaagtgttgatcgacggccagcagcggatcaccgcattgatggcagccattgccgggcaggaggttctggatgaggactttaaccgcgaccgcattaagattgcgttcaatcctctggcctcagatgatagcaaacgctttgccgtacaggatgcctctcacctgaaggacaagcggtggattccggacatttctgtggttttccgaccggaatttgatccatttgatttctccattcgctactgtgagagcaatgacggcattacgcccaatgaggttaaccgcgcactcaatgatttgaaaggcattgccaatcgacagatcggtgtcattgaactgaaccatacgctggatattgatgaagtgacggaaatcttcatccgtatcaactccaagggtacgccgttgagtcagtccgactttgtcatgtcaaaaatggcggcggacatggagcacggaggaaaccttatgcggaaggcagtagattatttctgccatctggccgtgaaacccgaattttatacccagctgactcatgattcagaattccagcagtcaaagtatgcgtcaaaaatccagtggttgtccaaagattatgaggacatctacgacccggattatggcgatatgttgcgggtgtccttcatgcatcaattccatcgaggaaagctcgcggatctggtgagcctgctctcggcagagattttaagacaaaggagttccgggaggatattgtcgctgactcctaccagaagctggatcagggccttttgaatttcatgaaccactataacttgatcattcgttttggcgatcaaaggcgccggcttctgttccagcaagctgctgaaactcagctatgacaatggatttcgcgtacactctctacctgcttctcctgaatgatcctgcgattcccaacgaccagatcaagcggtatgttcagaagtggttcgtcctgtccacccttacttcccgctacattggctcgccggaatcccagatggaccgcgatatgcgcagcatggaagaaaaggggtttcttgctttcctggaggaagtggaggcctccgcgctctcctctatgccctggtctttgacctggatggggtgggtatgccccagctccgggacacgctgcaccagatgaacaaggatattcttccccaggcaacctttgtcgtaaacagcgggacggggctgcacctgtattatgtgctggaggagccgatccctatgtacccgcacaaccagaaatgcttaaaggaattgaagtattccctcacccggcagatctggaacaggtacacctccaccatcaaggagccgcaaatgcagggcattttgcagggcttccgggtagtcggctccggctccaaacttggcagggagtacccggtgacggcctatcggctcggcgggcgggtgacgctggagaagctgctggagtttatccctgatagcaacggggagcagcagcagctcctgggccttatgcggaaggggcggctctcgctggccgaggcgaaggagaagtacccggactggtatgagcggcggatcgtcaaaaaggagcgccggggccgttggacggtcaagcggaatctctatgattggtggctacaccgtattgctgacgagatccgggttggccaccgtttctacggtattatgacgctggcgatttacgcaaagaagtgcgggatcagtgaggaggagctgcgccatgacgctttctccctgttgaaaccctatgacgatatgagcgtggaggatatcaaccgctttacgaaggatgatgttgtgtgcgctctggagatgttcaacgaggactatgtgacattccccagggacgatatagcgaagatctccggcctgtctatgcccgttaataagcgaaactggcgtaagcaagcagagcatttgcgcagggcacgggccgtccagatggttgattatccgaattttgagtgggctggtcgcccgtcggcccaagaccgggtgtataagtggcgtcaagagcacccggagggccgcaaggccgactgccaccgggatacgggtcttgatccaaagacgattcggaagtggtgggataaaataagttgatattttagcgcaattatgctaaaatattggcgaggtgatattatgaaaatgatccgacctgtttcagacttgcggaataattttgctgatatctcgaaaacagtgcatgagacggcgcagccggttttcctcacgaagaatggatacggcgatatggttgtattaagtatggatgcatttgaaaatctgcagtttgagagcgaagtatatttcaagttgcaggaggcagaacgagaagcgaagcttactgataagcggtattcttctaaagaagtattgaaggccatgagagacgccataggaggggaacaggttgtataatctggagtacctgcctgttgctctccaggacatggttgcgatcgtccggtatattagcagagagttaggaaatccagcagcagcggatcgacttgctacagagctgattgacgccggggatagtatccctaaatttccgtatatgaattcgtcatataccccgatccggccattaaagcatgaataccggaaggtgctggtacagaattatttcatattttattgggtagacgaagaaaagaaactgataacaatcgctcgggtggtatacgcaaagagcaattacgacccgttgcttgagtagacgggatctttctgtttggaataggcgggggatatgggtggagcagatgagatttgatcaagagaacgagcagcctcttgaaaaaacatcaatgtccgaatggtatgcctttagagagagcctggattcttttaccgatgatattttcgccgagggacggaatcagggaacgcaagagcaaagagacaatctggactaatcagcaatatattacataatttatataaattaaataagtgaaataagaataatcgaggatgtgatcatagtgggagtgaaggtgctgcagatcggctatgagccggagcgggatcgtctgacctgggacggttgggatattcactgtgggcagggcctggaggtattgctccctgaccggctcggcggaggaacgtggcggccggtgtcctttgagtacaacgccggcgggtggtatatgcctgggcagcctgggttgtctccggttggcctatgggccagagagagtgatggatgaatttggacgcaacgaaaccgtttcattgactctttgggttttatcacggaaagaacggaaaaaggtcgaggcatatgcctcgaccttttttacttgatataacaggaataaatgatatacttgaaataaagtatataacgtaaataaataacataagtaaataaaggagtgaacatggtgaaggtaattgcaatcgcaaaccagaagggcggggtggccaagaccaccacgacgcacaacctgggggcggccatggcggccgccgggaaaagggtgctgctcattgacctggacagccaagccagcctgacgatcagcgtgggcctggagccgttggaggtggagcggacgatcgtggacgtgctgcgaaaggatgggacgccgttcatggagtgtgtgcagcagctcagtgaccgactgcacattgtcacctcgatcatcgacttggcacccatggagatggagctgctctccagagccagccgggagaagatcttagaccgggcgctccgggaggccagggggcagtatgactatattttgattgactgtccgccgcagctctctatcctgaccatcaatgccctgtcctgcgccgacggagtggtgatcccagttaagacggattacctggcctaccgggggctgacgcagctccaggacagcatccaggagatccaggagctgattaacccggagctgaaggtgctgggggtgatcgccacactgtacgataccagggtgggcgatgaccatgatatcctgggtctgctctgtaaggagtacaatcttttgggcgtgatcaaacggctggccgtagcgaaaaaaggaatatatgacggcctggcggctgtggagcaggcccccagcagtgagcttgcgcaggaatacgtggccatagcaaacatgattatgtccggcagggagaagagggaggagcaggagcatgagtaagctggaggaaagggaaagccgcaggagatccgccacggttgggaaattcgtggagcagacgcccatggcggctaccagctccggtcggcggggtcggccgaaggagaaccgggagctgaaaaagcggattagtctctcggtgctacctagcttgtatgaggacatccagaagattgcctatgtgcagcggaaaagcacaagcgaagtggttcaagaaatgatggaggaatatcggaaaagaaatatcgaaaaactgggcgagtatgaccggctacagacagaagtgtgattttagaatagtgcaagaaaaagatgcaatagtagtaaaataaggcggtgagaaaacaaggttttctcaccgccttattttagtgtcatttattcttgtggatatatttaataaaacagatgattccaagaataaggaatataaattttaatgcggaaagtagaactgaaaacaagattggaaggatcaacatgggattcaaagggttgcgcccccaccaatagtatgctctgaactataactatgcttaatacctgcaacaggccctgtccatgatacaaccaaagttcccgttgcgtaacactccatattgctggcaccgttctgagtccatatttttgattcaaaaccatcatgctgggtccaggattcaaaattaaaggcgtatccaagttgttttgtagtcatatcgtcaatactcataaaaacattatattgagcatctatagtcgtgtcgacttcggcataaatatctgcggcacccatattagagggacttttaatcgtttttgtcatagaataagtttttttatagggcattacagcattaggaacggcggtatcaagcggttcgggttcggggatgatctcaacgaatgactgcaactcctcactataatttgtaacggagctcatgcgagatctaatatcatttagtctctcattaagaaagtcctgtgtaaatgtagccgacgggtcataaccttctgctgtatacccaatgtgaaattttgcatattcatcttgaattgcttgaaagaactcttccgctgagatagtttcggctttattttcattggtggaatcgagagctgaggctatgggaaaagaggataataacagggttaatgtaagtagaaaagcgataggttttttcatgttttacgcaccccttccagttttttgaggaaatagagaaacatgcgagttcatattcagagtatataaaagatacacatgaaagtcaatagaaagccaagctattttggctaaaatataaaaaatgatttaaaatagagttttcttgtataacggtttacccgtttatataatgaacgggtaaaccgttatacggttatctttcgtaataagttgacagtctggattatctatggtaacatgacactggaggaaaacgtgtatttgcaggggctacggatcagcggctccagcaggaaggaggcaggatcaaacggctgtggccggtgttggccgggagctgcagcagagatttcatgctcgtctgggcgagggtaaatagtaattaggcccagagcgtcttggccgggagctgccggtcaggggtttagcagtttgctaatataggagccgagataggtttgatacccctatgtggtgcgtgggctcgccgcagtaacctttgtgaaatggtaagcgcaccattgaccccgtatgagtaatccttttgaaagtacgggtaagtacaacgtatctgtccctataaacccttcggatagtagctggcatactgtaaatctgccggagagtagctcactctaaaaaggagccgacagatcccgaactgccgtagatctcaataaaccggggctgcacacataagcagatcaaaaaagtgtaggggagagaaccccaaaccgtcatacataagacgttaaaaagtgtatttgccaaatgccgggccccatgggcaggcaggcggcggccttagctttaacgtatattaattatataatgggaatatattaaataatttatataaattaaataggatatataagttatatgagcgatacgaaagaatggaggtaacagtgggccgcaggaataaggcgtactataaagacctccatcagcaagcatatgacaagctggtggggatgcaagccttcggggagagcaaacgggcggcggtggccgcaggtacggataaggagaagattttctccttcaacacctacaagagctactggaagcacaccaagtattttatccagtacatcaaggagcatcacccggaatgtaccacactgaaaagcgccaggaagtacgtcaacgagtggctgcaggccagggccgaccaggggctttccgcctggacggtacagttggaggccaaggccatgggaaagctgtacggtatttctcctgacgatgaaaactacttcaagcccccaaagcggaaccgggaggatatcaagcggagccgcggcgaccgggtgcgtgaccggcacttttccaagaccaacaacgacgagctggttaagttctgcaaggggacggggctgcgccggagcgagctggcggaactgcgggggaaagatctggtgccccgggcggagattgaagcggagatctccagcctggagagccgcccgacggcggagctgacgccagcagacgtgaagcgcctggggatgctccaggacgcccggatgttccagggggagtattttacccacgtgaggaacggaaaaggcggcagagagcgcctgagccccattatcggcccaaatgcggcgcagatcgtccagcggatacaggagacgccgggcgaggaaaaggtgtggcagcatgtccaccagagcgccgatattcacggctaccgggctgagtacgcaacggccatttacaaggcccacgccagggcaatccaggatatcccctacgaccggataaaccgtgggacgggacgccggtatcagagccaggtctacacctgcaggaaggacgaggccgggcggaaactggacaaggcggccatgctggtgtgcagtaaggccctggggcataaccggatcagtgtggtggccgacaactatatccggggcctgtaaggggggatatgatggctgagtttgcgaaaaagggtgtcatgggctataaagtgctccctggcggccggaacgacagcgagagcacccatgcgattctttctctggaggagtatgacgagctgctgcgccggattgctgtggcggaacgtgataagcacgaggcgatcgcacaggcaaagagaacgataggaagagaacaggccgccgccgagcagcgggccagggaggccgaagaggccgcgcaggaacaggtgacggccatggaggagaagctgaccagggctgaggaagaggtcagttaccagaagggccttaacgcaaatctgctgcggatttcacgggagcgggcgaatgccgaccggagcctccggcccaagaaggagcataccgggtatgcggtggttcgctccatggagaaggagtaccgctataagataagccgccagagctggggaaaggtaatgctttgggaaactgtgatacagagtccctattcaatggagtttaccgaggagcaggccaggaagcagatcaggagagaactacttcgggataagaacggcggggactggctgattggcaaagtagggattcgggtgagctgcgacctggagtttgaggacatgattcaatacagcgaatggtgggaggagcatagagaagaaaacatcatgatgaagcggaagctgaatctaaatggccgtagtgggtattgggaggtagttttttaccacacacggcccctggggcctgtaccggaggaaatgaggccctgcgtgcgttaaacttcctcctgcagcacaaaagaaaatagctcggctggaggacttgaaaaggtctatccagtcgagctataataaagtcgaaaaatagggaaaaaagtattgataatatatgccccctaaagggcctttaggcccttaaaaaatatcttaaaattctctctcggacagggagaaagtcggaggggaaaaggggggtgagcggcggggtgtgggaatgtggtaaacccgtagggttttccatcatttccatgccccagagcgaggggggaaagggggaggtgactttctctttaaggccccgaaggggccgctctttggctccccctttccccccttcccgcccgcaggcgatccccgccgcagcggattttctttttgctactttttcttttggaggcgattgctttgtttgttaggaaacagaaaggaaaaccagaagaaagtaagactgtccggcagtgggcgcttctggggcggatacctatagatgcgctgaaaccgaattacatctgggagacgcagaccgatggcccagtaacggtttattatcatgaaaagaatacccgagaaatgacagaagaggaaaaggcagattttttagcggaccagaagggctatggtcagaggtatttgcagatgataattcaagaaaaaaagaggttgaagagagcgtgatggtacagaatgagggatgaacaggataatatggagctgttgcgggcgttgtatcaggaaaaaaatgaacatttggagaagttcctggagccggtcacgccctttgagttttaccgggagatattccccgtgggcagctttgagcggaagggccattttgaggacgttaagggcaacgggatcgcggtgacggtgccgccaaaggctgcagggattgccctggaaatccaggaggaaggcaaggccaaacactacacgatcaccgatgagctgttggagttgtcggaggtctgcgacacagattttactatcatgtcaccgctgtcttactttgggcggcggcgatgcggcaagaatgcccggtat

SEQ ID NO: 34 - DNA, 3497674 bp, Roseburia hominis; identical to SEQ ID NO: 24
